United States Patent
Lundberg et al.

(10) Patent No.: US 11,459,587 B2
(45) Date of Patent: Oct. 4, 2022

(54) MATERIALS AND METHODS FOR TREATMENT OF PAIN RELATED DISORDERS

(71) Applicant: VERTEX PHARMACEUTICALS INCORPORATED, Boston, MA (US)

(72) Inventors: Ante Sven Lundberg, Cambridge, MA (US); Samarth Kulkarni, Cambridge, MA (US); Lawrence Klein, Cambridge, MA (US); Hari Kumar Padmanabhan, Cambridge, MA (US)

(73) Assignee: VERTEX PHARMACEUTICALS INCORPORATED, Boston, MA (US)

(*) Notice: Subject to any disclaimer, the term of this patent is extended or adjusted under 35 U.S.C. 154(b) by 699 days.

(21) Appl. No.: 16/315,547

(22) PCT Filed: Jul. 6, 2017

(86) PCT No.: PCT/IB2017/054086
§ 371 (c)(1),
(2) Date: Jan. 4, 2019

(87) PCT Pub. No.: WO2018/007980
PCT Pub. Date: Jan. 11, 2018

(65) Prior Publication Data
US 2019/0153477 A1 May 23, 2019

Related U.S. Application Data

(60) Provisional application No. 62/461,874, filed on Feb. 22, 2017, provisional application No. 62/358,763, filed on Jul. 6, 2016.

(51) Int. Cl.
*C12N 15/90* (2006.01)
*A61K 35/30* (2015.01)
*C07K 14/705* (2006.01)
*C12N 9/22* (2006.01)
*C12N 15/11* (2006.01)
*C12N 15/113* (2010.01)
*A61P 25/04* (2006.01)
*A61P 43/00* (2006.01)

(52) U.S. Cl.
CPC ............ *C12N 15/907* (2013.01); *A61K 35/30* (2013.01); *C07K 14/705* (2013.01); *C12N 9/22* (2013.01); *C12N 15/11* (2013.01); *C12N 15/1138* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| | | |
|---|---|---|
| 3,687,808 A | 8/1972 | Merigan, Jr. et al. |
| 4,469,863 A | 9/1984 | Ts'o et al. |
| 4,476,301 A | 10/1984 | Imbach et al. |
| 4,587,044 A | 5/1986 | Miller et al. |
| 4,605,735 A | 8/1986 | Miyoshi et al. |
| 4,667,025 A | 5/1987 | Miyoshi et al. |
| 4,762,779 A | 8/1988 | Snitman |
| 4,789,737 A | 12/1988 | Miyoshi et al. |
| 4,824,941 A | 4/1989 | Gordon et al. |
| 4,828,979 A | 5/1989 | Klevan et al. |
| 4,835,263 A | 5/1989 | Nguyen et al. |
| 4,845,205 A | 7/1989 | Huynh Dinh et al. |
| 4,876,335 A | 10/1989 | Yamane et al. |
| 4,904,582 A | 2/1990 | Tullis |
| 4,948,882 A | 8/1990 | Ruth |
| 4,958,013 A | 9/1990 | Letsinger |
| 5,023,243 A | 6/1991 | Tullis |
| 5,034,506 A | 7/1991 | Summerton et al. |
| 5,082,830 A | 1/1992 | Brakel et al. |
| 5,109,124 A | 4/1992 | Ramachandran et al. |
| 5,112,963 A | 5/1992 | Pieles et al. |
| 5,118,802 A | 6/1992 | Smith et al. |
| 5,130,302 A | 7/1992 | Spielvogel et al. |
| 5,134,066 A | 7/1992 | Rogers et al. |
| 5,138,045 A | 8/1992 | Cook et al. |
| 5,166,315 A | 11/1992 | Summerton et al. |
| 5,173,414 A | 12/1992 | Lebkowski et al. |
| 5,175,273 A | 12/1992 | Bischofberger et al. |
| 5,177,196 A | 1/1993 | Meyer, Jr. et al. |

(Continued)

FOREIGN PATENT DOCUMENTS

| EP | 2 112 235 A1 | 10/2009 |
|---|---|---|
| EP | 2263705 A1 | 12/2010 |

(Continued)

OTHER PUBLICATIONS

Genbank Accession No. AY243025.1 (which was publically available since Apr. 10, 2003, retrieved from the Internet <<https://www.ncbi.nlm.nih.gov/nuccore/AY243025.1>>, retrieved on Aug. 25, 2021).*
Uniprot Accession No. Q99ZW2 (publically available since Jul. 2012, retrieved from the Internet << https://www.uniprot.org/uniprot/Q99ZW2 >>, retrieved on Aug. 26, 2021.*
Warren et al., "Highly Efficient Reprogramming to Pluripotency and Directed Differentiation of Human Cells with Synthetic Modified mRNA", Cell Stem Cell, 2010, pp. 618-630, vol. 7.
Weber et al., "Methylation of Human MicroRNA Genes in Normal and Neoplastic Cells", Cell Cycle, 2007, pp. 1001-1005, vol. 6, No. 9.

(Continued)

*Primary Examiner* — Suzanne M Noakes
*Assistant Examiner* — Jae W Lee
(74) *Attorney, Agent, or Firm* — Polsinelli PC

(57) ABSTRACT

The present application provides materials and methods for treating a patient with one or more conditions associated with SCN9A whether ex vivo or in vivo. In addition, the present application provides materials and methods for editing and/or modulating the expression of SCN9A gene in a cell by genome editing.

17 Claims, 11 Drawing Sheets

Specification includes a Sequence Listing.

(56) References Cited

U.S. PATENT DOCUMENTS

| | | |
|---|---|---|
| 5,185,444 A | 2/1993 | Summerton et al. |
| 5,188,897 A | 2/1993 | Suhadolnik et al. |
| 5,214,134 A | 5/1993 | Weis et al. |
| 5,214,136 A | 5/1993 | Lin et al. |
| 5,216,141 A | 6/1993 | Benner |
| 5,218,105 A | 6/1993 | Cook et al. |
| 5,235,033 A | 8/1993 | Summerton et al. |
| 5,245,022 A | 9/1993 | Weis et al. |
| 5,254,469 A | 10/1993 | Warren, III et al. |
| 5,258,506 A | 11/1993 | Urdea et al. |
| 5,262,536 A | 11/1993 | Hobbs, Jr. |
| 5,264,423 A | 11/1993 | Cohen et al. |
| 5,264,562 A | 11/1993 | Matteucci |
| 5,264,564 A | 11/1993 | Matteucci |
| 5,272,250 A | 12/1993 | Spielvogel et al. |
| 5,276,019 A | 1/1994 | Cohen et al. |
| 5,278,302 A | 1/1994 | Caruthers et al. |
| 5,286,717 A | 2/1994 | Cohen et al. |
| 5,292,873 A | 3/1994 | Rokita et al. |
| 5,317,098 A | 5/1994 | Shizuya et al. |
| 5,321,131 A | 6/1994 | Agrawal et al. |
| 5,367,066 A | 11/1994 | Urdea et al. |
| 5,371,241 A | 12/1994 | Brush |
| 5,391,723 A | 2/1995 | Priest |
| 5,399,676 A | 3/1995 | Froehler |
| 5,405,938 A | 4/1995 | Summerton et al. |
| 5,405,939 A | 4/1995 | Suhadolnik et al. |
| 5,414,077 A | 5/1995 | Lin et al. |
| 5,416,203 A | 5/1995 | Letsinger |
| 5,432,272 A | 7/1995 | Benner |
| 5,434,257 A | 7/1995 | Matteucci et al. |
| 5,451,463 A | 9/1995 | Nelson et al. |
| 5,453,496 A | 9/1995 | Caruthers et al. |
| 5,455,233 A | 10/1995 | Spielvogel et al. |
| 5,457,187 A | 10/1995 | Gmeiner et al. |
| 5,459,255 A | 10/1995 | Cook et al. |
| 5,466,677 A | 11/1995 | Baxter et al. |
| 5,470,967 A | 11/1995 | Huie et al. |
| 5,476,925 A | 12/1995 | Letsinger et al. |
| 5,484,908 A | 1/1996 | Froehler et al. |
| 5,486,603 A | 1/1996 | Buhr |
| 5,489,677 A | 2/1996 | Sanghvi et al. |
| 5,502,177 A | 3/1996 | Matteucci et al. |
| 5,510,475 A | 4/1996 | Agrawal et al. |
| 5,512,439 A | 4/1996 | Hornes et al. |
| 5,512,667 A | 4/1996 | Reed et al. |
| 5,514,785 A | 5/1996 | Van Ness et al. |
| 5,519,126 A | 5/1996 | Hecht |
| 5,525,465 A | 6/1996 | Haralambidis et al. |
| 5,525,711 A | 6/1996 | Hawkins et al. |
| 5,536,821 A | 7/1996 | Agrawal et al. |
| 5,539,082 A | 7/1996 | Nielsen et al. |
| 5,541,306 A | 7/1996 | Agrawal et al. |
| 5,541,307 A | 7/1996 | Cook et al. |
| 5,541,313 A | 7/1996 | Ruth |
| 5,545,730 A | 8/1996 | Urdea et al. |
| 5,550,111 A | 8/1996 | Suhadolnik et al. |
| 5,552,538 A | 9/1996 | Urdea et al. |
| 5,552,540 A | 9/1996 | Haralambidis |
| 5,561,225 A | 10/1996 | Maddry et al. |
| 5,563,253 A | 10/1996 | Agrawal et al. |
| 5,565,552 A | 10/1996 | Magda et al. |
| 5,567,810 A | 10/1996 | Weis et al. |
| 5,571,799 A | 11/1996 | Tkachuk et al. |
| 5,574,142 A | 11/1996 | Meyer, Jr. et al. |
| 5,578,717 A | 11/1996 | Urdea et al. |
| 5,578,718 A | 11/1996 | Cook et al. |
| 5,580,731 A | 12/1996 | Chang et al. |
| 5,585,481 A | 12/1996 | Arnold, Jr. et al. |
| 5,587,361 A | 12/1996 | Cook et al. |
| 5,587,371 A | 12/1996 | Sessler et al. |
| 5,587,469 A | 12/1996 | Cook et al. |
| 5,591,584 A | 1/1997 | Chang et al. |
| 5,595,726 A | 1/1997 | Magda et al. |
| 5,596,086 A | 1/1997 | Matteucci et al. |
| 5,596,091 A | 1/1997 | Switzer |
| 5,597,696 A | 1/1997 | Linn et al. |
| 5,599,923 A | 2/1997 | Sessler et al. |
| 5,599,928 A | 2/1997 | Hemmi et al. |
| 5,602,240 A | 2/1997 | De Mesmaeker et al. |
| 5,608,046 A | 3/1997 | Cook et al. |
| 5,610,289 A | 3/1997 | Cook et al. |
| 5,614,617 A | 3/1997 | Cook et al. |
| 5,618,704 A | 4/1997 | Sanghvi et al. |
| 5,623,070 A | 4/1997 | Cook et al. |
| 5,625,050 A | 4/1997 | Beaton et al. |
| 5,633,360 A | 5/1997 | Bischofberger et al. |
| 5,658,776 A | 8/1997 | Flotte et al. |
| 5,663,312 A | 9/1997 | Chaturvedula |
| 5,677,437 A | 10/1997 | Teng et al. |
| 5,677,439 A | 10/1997 | Weis et al. |
| 5,681,941 A | 10/1997 | Cook et al. |
| 5,688,941 A | 11/1997 | Cook et al. |
| 5,714,331 A | 2/1998 | Buchardt et al. |
| 5,719,262 A | 2/1998 | Buchardt et al. |
| 5,750,692 A | 5/1998 | Cook et al. |
| 5,763,588 A | 6/1998 | Matteucci et al. |
| 5,786,211 A | 7/1998 | Johnson |
| 5,830,653 A | 11/1998 | Froehler et al. |
| 5,871,982 A | 2/1999 | Wilson et al. |
| 6,005,096 A | 12/1999 | Matteucci et al. |
| 6,156,303 A | 12/2000 | Russell et al. |
| 6,258,595 B1 | 7/2001 | Gao et al. |
| 6,287,860 B1 | 9/2001 | Monia et al. |
| 7,427,396 B2 | 9/2008 | Arbetman et al. |
| 7,588,772 B2 | 9/2009 | Kay et al. |
| 8,252,538 B2 | 8/2012 | Croce et al. |
| 8,389,210 B2 | 3/2013 | Croce et al. |
| 8,415,096 B2 | 4/2013 | Mohapatra et al. |
| 9,193,769 B2 | 11/2015 | Chiorini et al. |
| 9,238,800 B2 | 1/2016 | Bossis et al. |
| 2003/0158403 A1 | 8/2003 | Manoharan et al. |
| 2005/0059005 A1 | 3/2005 | Tuschl et al. |
| 2005/0261218 A1 | 11/2005 | Esau et al. |
| 2009/0092974 A1 | 4/2009 | Davison et al. |
| 2009/0131348 A1 | 5/2009 | Labourier et al. |
| 2009/0263803 A1 | 10/2009 | Beaudenon et al. |
| 2010/0286232 A1 | 11/2010 | Schmittgen et al. |
| 2010/0323357 A1 | 12/2010 | Nana-Sinkam et al. |
| 2011/0016541 A1 | 1/2011 | Weinstein et al. |
| 2011/0023148 A1 | 1/2011 | Weinstein et al. |
| 2011/0171646 A1 | 7/2011 | Schmittgen et al. |
| 2011/0281756 A1 | 11/2011 | Wu et al. |
| 2012/0053224 A1 | 3/2012 | Meister et al. |
| 2012/0214699 A1 | 8/2012 | Croce et al. |
| 2012/0264626 A1 | 10/2012 | Nana-Sinkam et al. |
| 2012/0283310 A1 | 11/2012 | Croce et al. |
| 2012/0309645 A1 | 12/2012 | Keller et al. |
| 2012/0316081 A1 | 12/2012 | List et al. |
| 2012/0329672 A1 | 12/2012 | Croce et al. |
| 2013/0042333 A1 | 2/2013 | Judde et al. |
| 2013/0053263 A1 | 2/2013 | Keller et al. |
| 2013/0053264 A1 | 2/2013 | Keller et al. |
| 2013/0059015 A1 | 3/2013 | Lancaster et al. |
| 2014/0068797 A1 | 3/2014 | Doudna et al. |
| 2015/0291966 A1 | 10/2015 | Zhang et al. |
| 2016/0017005 A1 | 1/2016 | Asokan et al. |
| 2017/0121693 A1 | 5/2017 | Liu et al. |
| 2018/0258424 A1* | 9/2018 | Greenberg .......... C12N 5/0619 |

FOREIGN PATENT DOCUMENTS

| | | |
|---|---|---|
| JP | 2009215191 A | 9/2009 |
| JP | 2013500018 A | 1/2013 |
| WO | 93/07883 A1 | 4/1993 |
| WO | 95/13365 A1 | 5/1995 |
| WO | 95/13392 A1 | 5/1995 |
| WO | 96/17947 A1 | 6/1996 |
| WO | 97/06243 A1 | 2/1997 |
| WO | 97/08298 A1 | 3/1997 |
| WO | 97/09441 A2 | 3/1997 |
| WO | 97/21825 A1 | 6/1997 |
| WO | 99/11764 A2 | 3/1999 |
| WO | 01/83692 A2 | 11/2001 |

(56) References Cited

FOREIGN PATENT DOCUMENTS

| | | |
|---|---|---|
| WO | 2007/081740 A2 | 7/2007 |
| WO | 2008/054828 A2 | 5/2008 |
| WO | 2008/073915 A2 | 6/2008 |
| WO | 2008/154098 A2 | 12/2008 |
| WO | 2009/070653 A1 | 6/2009 |
| WO | 2009/100430 A2 | 8/2009 |
| WO | 2010/018563 A2 | 2/2010 |
| WO | 2010140698 A1 | 12/2010 |
| WO | 2011011767 A1 | 1/2011 |
| WO | 2011/076142 A1 | 6/2011 |
| WO | 2011/076143 A1 | 6/2011 |
| WO | 2011/095623 A2 | 8/2011 |
| WO | 2011/157294 A1 | 12/2011 |
| WO | 2012/151212 A1 | 11/2012 |
| WO | 2013/011378 A1 | 1/2013 |
| WO | 2013/033640 A1 | 3/2013 |
| WO | 2013/066678 A1 | 5/2013 |
| WO | 2013061205 A2 | 5/2013 |
| WO | 2013/176772 A1 | 11/2013 |
| WO | 2014/159595 A2 | 10/2014 |
| WO | 2015/048577 A2 | 4/2015 |
| WO | 2015/051216 A1 | 4/2015 |
| WO | 2015/070083 A1 | 5/2015 |
| WO | 2015/121501 A1 | 8/2015 |
| WO | 2015/175642 A2 | 11/2015 |
| WO | 2016/057800 A1 | 4/2016 |
| WO | 2016/191684 A1 | 12/2016 |
| WO | 2017/024319 A1 | 2/2017 |
| WO | 2017/075222 A1 | 5/2017 |
| WO | 2017/083722 A1 | 5/2017 |
| WO | 2018/007976 A1 | 1/2018 |
| WO | 2018/007980 A1 | 1/2018 |
| WO | 2018/022668 A2 | 2/2018 |
| WO | 2018/035503 A1 | 2/2018 |
| WO | 2018/049079 A1 | 3/2018 |
| WO | 2018/165503 A1 | 9/2018 |
| WO | 2018/165504 A1 | 9/2018 |

OTHER PUBLICATIONS

Weber et al., "A Modular Cloning System for Standardized Assembly of Multigene Constructs", PLoS One, 2011, e16765, pp. 1-11, vol. 6, No. 2.
Whitehead et al., "Silencing or Stimulation? siRNA Delivery and the Immune System", Annual Review of Chemical and Biomolecular Engineering, 2011, pp. 77-96, vol. 2.
Winkler, "Oligonucleotide conjugates for therapeutic applications", Ther. Deliv., 2013, pp. 791-809, vol. 4, No. 7.
Wolfs et al., "MegaTevs: single-chain dual nucleases for efficient gene disruption", Nucleic Acids Research, 2014, pp. 8816-8829, vol. 42, No. 13.
Zhao et al., "Sequence-specific inhibition of microRNA via CRISPR/CRISPRi system", Scientific Reports, 2014, pp. 1-5, vol. 4.
International Search Report and Written Opinion relating to International Application No. PCT/IB2017/054086, dated Nov. 8, 2017; 10 pgs.
Ma et al., "Pol III Promoters to Express Small RNAs: Delineation of Transcription Initiation", Molecular Therapy—Nucleic Acids, 2014, e161, pp. 1-11, vol. 3.
Maherali et al., "Guidelines and Techniques for the Generation of Induced Pluripotent Stem Cells", Cell Stem Cell, 2008, pp. 595-605, vol. 3.
Mak et al., "The crystal structure of TAL effector PthXo1 bound to its DNA target", Science, 2012, pp. 716-719, vol. 335, No. 6069.
Manoharan et al., "Introduction of a Lipophilic Thioether Tether in the Minor Groove of Nucleic Acids for Antisense Applications", Bioorganic & Medicinal Chemistry Letters, 1993, pp. 2765-2770, vol. 3, No. 12.
Manoharan et al., "Chemical Modifications to Improve Uptake and Bioavailability of Antisense Oligonucleotides", Annals New York Academy of Sciences, 1994, pp. 306-309, vol. 660.
Manoharan et al., "Cholic Acid-Oligonucleotide Conjugates for Antisense Applications", Bioorganic & Medicinal Chemistry Letters, 1994, pp. 1053-1060, vol. 4, No. 8.
Manoharan et al., "Oligonucleotide Conjugates: Alteration of the Pharmacokinetic Properties of Antisense Agents", Nucleosides & Nucleotides, 1995, pp. 969-973, vol. 14.
Manoharan et al., "Lipidic Nucleic Acids", Tetrahedron Letters, 1995, pp. 3651-3654, vol. 36, No. 21.
Maresca et al., "Obligate Ligation-Gated Recombination (ObLiGaRe): Custom-designed nuclease-mediated targeted integration through nonhomologous end joining", Genome Research, 2013, pp. 539-546, vol. 23.
Marson et al., "Wnt Signaling Promotes Reprogramming of Somatic Cells to Pluripotency", Cell Stem Cell, 2008, pp. 132-135, vol. 3.
Martin et al., "38. Ein neuer Zugang zu 2'-O-Alkylribonucleosiden und Eigenschaften deren Oligonucleotide". Helvetica Chimica Acta, 1995, pp. 486-504, vol. 78.—English abstract.
Mateos-Gomez et al., "Mammalian Polymerase Theta Promotes Alternative-NHEJ and Suppresses Recombination", Nature, 2015, pp. 254-257, vol. 518.
McLaughlin et al., "Adeno-Associated Virus General Transduction Vectors: Analysis of Proviral Structures", Journal of Virology, 1988, pp. 1963-1973, vol. 62, No. 6.
Mishra et al., "Improved leishmanicidal effect of phosphorotioate antisense oligonucleotides by LDL-mediated delivery", Biochimica et Biophysica Acta, 1995, pp. 229-237, vol. 1264.
Moscou et al., "A Simple Cipher Governs DNA Recognition by TAL Effectors", Science, 2009, p. 1501, vol. 326.
Muzyczka, "Use of Adeno-Associated Virus as a General Transduction Vector for Mammalian Cells", Current Topics in Microbiology and Immunology, 1992, pp. 97-129, vol. 158.
Nasevicius et al., "Effective targeted gene 'knockdown' in zebrafish", Nature Genetics, 2000, pp. 216-220, vol. 26.
Nielsen et al., "Sequence-Selective Recognition of DNA by Strand Displacement with a Thymine-Substituted Polyamide", Science, 1991, pp. 1497-1500, vol. 254.
Oberhauser et al., "Effective incorporation of 2'-O-methyl-oligoribonucleotides into liposomes and enhanced cell association through modification with thiocholesterol", Nucleic Acids Research, 1992, pp. 533-538, vol. 20, No. 3.
Paul et al., "Increased Viral Titer Through Concentration of Viral Harvests from Retroviral Packaging Lines", Human Gene Therapy, 1993, pp. 609-615, vol. 4.
Peer et al., "Special delivery: targeted therapy with small RNAs", Gene Therapy, 2011, pp. 1127-1133, vol. 18.
Perrin et al., "An experimental rabies vaccine produced with a new BHK-21 suspension cell culture process: use of serum-free medium and perfusion-reactor system", Vaccine, 1995, pp. 1244-1250, vol. 13, No. 13.
Pittenger et al., "Multilineage Potential of Adult Human Mesenchymal Stem Cells", Science, 1999, pp. 143-147, vol. 284.
Posadas et al., "MicroRNAs and their roles in developmental canalization", Curr Opin Genet Dev., 2014, pp. 1-6, vol. 27.
Pulicherla et al., "Engineering Liver-detargeted AAV9 Vectors for Cardiac and Musculoskeletal Gene Transfer", Molecular Therapy, 2011, pp. 1070-1078, vol. 19, No. 6.
Saj et al., "Control of microRNA biogenesis and transcription by cell signaling pathways", Curr Opin Genet Dev., 2011, pp. 504-510, vol. 21, No. 4.
Samulski et al., "Helper-Free Stocks of Recombinant Adeno-Associated Viruses: Normal Integration Does Not Require Viral Gene Expression", Journal of Virology, 1989, pp. 3822-3828, vol. 63, No. 9.
Sapranauskas et al., "The *Streptococcus thermophilus* CRISPR/Cas system provides immunity in *Escherichia coli*", Nucleic Acids Research, 2011, pp. 9275-9282, vol. 39, No. 21.
Segal et al., "Toward controlling gene expression at will: Selection and design of zinc finger domains recognizing each of the 5'-GNN-3' DNA target sequences", PNAS, 1999, pp. 2758-2763, vol. 96.
Shea et al., "Synthesis, hybridization properties and antiviral activity of lipid-oligodeoxynucleotide conjugates", Nucleic Acids Research, 1990, pp. 3777-3783, vol. 18, No. 13.

(56) References Cited

OTHER PUBLICATIONS

Shi et al., "A Combined Chemical and Genetic Approach for the Generation of Induced Pluripotent Stem Cells", Cell Stem Cell, 2008, pp. 525-528, vol. 2.
Soutschek et al., "Therapeutic silencing of an endogenous gene by systemic administration of modified siRNAs", Nature, 2004, pp. 173-178, vol. 432.
Steentoft et al., "Precision genome editing: A small revolution for glycobiology", Glycobiology, 2014, pp. 663-680, vol. 24, No. 8.
Stern-Ginossar et al., "Host Immune System Gene Targeting by a Viral miRNA", Science, 2007, pp. 376-381, vol. 317, with Supporting Material.
Suzuki et al., "In vivo genome editing via CRISPR/Cas9 mediated homology-independent targeted integration", Nature, 2016, pp. 144-149, vol. 540, and extended data.
Svinarchuk et al., "Inhibition of HIV proliferation in MT-4 cells by antisense oligonucleotide conjugated to lipophilic groups", Biochimie, 1993, pp. 49-54, vol. 75.
Takahashi et al., "Induction of Pluripotent Stem Cells from Mouse Embryonic and Adult Fibroblast Cultures by Defined Factors", Cell, 2006, pp. 663-676, vol. 126.
Takahashi et al., "Induction of Pluripotent Stem Cells from Adult Human Fibroblasts by Defined Factors", Cell, 2007, pp. 861-872, vol. 131.
Tratschin et al., "A Human Parvovirus, Adeno-Associated Virus, as a Eucaryotic Vector: Transient Expression and Encapsidation of the Procaryotic Gene for Chloramphenicol Acetyltransferase", Molecular and Cellular Biology, 1984, pp. 2072-2081, vol. 4, No. 10.
Tratschin et al., "Adeno-Associated Virus Vector for High-Frequency Integration, Expression, and Rescue of Genes in Mammalian Cells", Molecular and Cellular Biology, 1985, pp. 3251-3260, vol. 5, No. 11.
Tsai et al., "Dimeric CRISPR RNA-guided FokI nucleases for highly specific genome editing", Nature Biotechnology, 2014, pp. 569-576, vol. 32, No. 6.
Volkov et al., "Selective Protection of Nuclease-Sensitive Sites in siRNA Prolongs Silencing Effect", Oligonucleotides, 2009, pp. 191-202, vol. 19, No. 2.
Wang et al., "Cyclohexene Nucleic Acids (CeNA): Serum Stable Oligonucleotides that Activate RNase H and Increase Duplex Stability with Complementary RNA", Journal of the American Chemical Society, 2000, pp. 8595-8602, vol. 122, No. 36.
Wang et al., "Rapid and Efficient Assembly of Transcription Activator-Like Effector Genes by USER Cloning", Journal of Genetics and Genomics, 2014, pp. 339-347, vol. 41, No. 6.
Wang et al., "Induced Pluripotent Stem Cells for Neural Tissue Engineering", Biomaterials, 2011, pp. 5023-5032, vol. 32, No. 22.
Anand et al., "MicroRNA-mediated Regulation of the Angiogenic Switch", Curr Opin Hematol., 2011, pp. 171-176, vol. 18, No. 3.
Andersen et al., "A rapid and versatile method for the isolation, purification and cryogenic storage of Schwann cells from adult rodent nerves", Scientific Reports—Nature, 2016, 31781, pp. 1-17, vol. 6.
Angart et al., "Design of siRNA Therapeutics from the Molecular Scale", Pharmaceuticals, 2013, pp. 440-468, vol. 6.
Annoni et al., "In vivo delivery of a microRNA-regulated transgene induces antigen-specific regulatory T cells and promotes immunologic tolerance", Blood, 2009, pp. 5152-5161, vol. 114, No. 25.
Barrett et al., "Reliable Generation of Induced Pluripotent Stem Cells From Human Lymphoblastoid Cell Lines", Stem Cells Translational Medicine, 2014, pp. 1429-1434, vol. 3.
Bartel, "MicroRNAs: Target Recognition and Regulatory Functions", Cell, 2009, pp. 215-233, vol. 136.
Behlke, "Chemical Modification of siRNAs for In Vivo Use", Oligonucleotides, 2008, pp. 305-319, vol. 18.
Belfort et al., "Homing Endonucleases: From Genetic Anomalies to Programmable Genomic Clippers", Methods Mol Biol., 2014, pp. 1-26, vol. 1123.
Boch et al., "Breaking the Code of DNA Binding Specificity of TAL-Type III Effectors", Science, 2009, pp. 1509-1512, vol. 326.

Boissel et al., "megaTALs: a rare-cleaving nuclease architecture for therapeutic genome engineering", Nucleic Acids Research, 2014, pp. 2591-2601, vol. 42, No. 4.
Boissel et al., "Assembly and Characterization of megaTALs for Hyperspeci! c Genome Engineering Applications", Methods in Molecular Biology, 2015, pp. 171-196, vol. 1239.
Bonauer et al., "Vascular microRNAs", Current Drug Targets, 2010, pp. 943-949, vol. 11.
Braasch et al., "Novel Antisense and Peptide Nucleic Acid Strategies for Controlling Gene Expression", Biochemistry, 2002, pp. 4503-4510, vol. 41, No. 14.
Bramsen et al., "Development of therapeutic-grade small interfering RNAs by chemical engineering", Frontiers in Genetics, 2012, pp. 1-22, vol. 3, No. 154.
Budniatzky et al., "Concise Review: Reprogramming Strategies for Cardiovascular Regenerative Medicine: From Induced Pluripotent Stem Cells to Direct Reprogramming", Stem Cells Translational Medicine, 2014, pp. 448-457, vol. 3.
Burnett et al., "Current Progress of siRNA/shRNA Therapeutics in Clinical Trials", Biotechnol J., 2011, pp. 1130-1146, vol. 6, No. 9.
Canver et al., "BCL11A enhancer dissection by Cas9-mediated in situ saturating mutagenesis", Nature, 2015, pp. 192-197, vol. 527.
Carter, "Adeno-associated virus vectors", Current Opinion in Biotechnology, 1992, pp. 533-539, vol. 3.
Ceccaldi et al., "Homologous recombination-deficient tumors are hyper-dependent on POLQ-mediated repair", Nature, 2015, pp. 258-262, vol. 518.
Cekaite et al., "Gene Expression Analysis in Blood Cells in Response to Unmodified and 2'-Modified siRNAs Reveals TLR-dependent and Independent Effects", J. Mol. Biol., 2007, pp. 90-108, vol. 365.
Communication pursuant to Article 94(3) EPC relating to EP Application No. 17754196.8, dated Jun. 4, 2020; 5 pgs.
Communication pursuant to Article 94(3) EPC relating to EP Application No. 17754197.6, dated Aug. 6, 2020; 6 pgs.
Cermak et al., "Efficient design and assembly of custom TALEN and other TAL effector-based constructs for DNA targeting", Nucleic Acids Research, 2011, e82, pp. 1-11, vol. 39, No. 12.
Cermak et al., "Efficient Design and Assembly of Custom TALENs Using the Golden Gate Platform", Methods in Molecular Biology, 2015, pp. 133-159, vol. 1239.
Chen et al., "Global microRNA depletion suppresses tumor angiogenesis", Genes & Development, 2014, pp. 1054-1067, vol. 28.
Chernolovskaya et al., "Chemical modification of siRNA", Current Opinion in Molecular Therapeutics, 2010, pp. 1-10, vol. 12, No. 2.
Cho et al., "Familiar ends with alternative endings", Nature, 2015, pp. 174-176, vol. 518.
Chylinski et al., "The tracrRNA and Cas9 families of type II CRISPR-Cas immunity systems", RNA Biology, 2013, pp. 726-737, vol. 10, No. 5.
Contreras et al., "MicroRNAs in inflammation and immune responses", Leukemia, 2012, pp. 404-413, vol. 26.
Cox et al., "Therapeutic Genome Editing: Prospects and Challenges", Nature Medicine, 2015, pp. 121-131, vol. 21, No. 2.
Cristea et al., "In vivo Cleavage of Transgene Donors Promotes Nuclease-Mediated Targeted Integration", Biotechnology and Bioengineering, 2013, pp. 871-880, vol. 110, No. 3.
Crooke et al., "Pharmacokinetic properties of several novel oligonucletide analogs in mice", The Journal of Pharmacology and Experimental Therapeutics, 1996, pp. 923-937, vol. 277.
De Mesmaeker et al., "Antisense Oligonucleotides", Acc. Chem. Res., 1995, pp. 366-374, vol. 28, No. 9.
Deltcheva et al., "CRISPR RNA maturation by trans-encoded small RNA and host factor RNase III", Nature, 2011, pp. 602-607, vol. 471.
Deverman et al., "Cre-dependent selection yields AAV variants for widespread gene transfer to the adult brain", Nature Biotechnology, 2016, pp. 204-209, vol. 34, No. 2.
Dreier et al., "Insights into the Molecular Recognition of the 5'-GNN-3' Family of DNA Sequences by Zinc Finger Domains", Journal of Molecular Biology, 2000, pp. 489-502, vol. 303.
Dreier et al., "Development of Zinc Finger Domains for Recognition of the 5'-ANN-3' Family of DNA Sequences and Their Use in

(56) References Cited

OTHER PUBLICATIONS the Construction of Artificial Transcription Factors", The Journal of Biological Chemistry, 2001, pp. 29466-29478, vol. 276, No. 31.

Dreier et al., "Development of Zinc Finger Domains for Recognition of the 5'-CNN-3' Family DNA Sequences and Their Use in the Construction of Artificial Transcription Factors", The Journal of Biological Chemistry, 2005, pp. 35588-35597, vol. 280, No. 42.

Focosi et al., "Induced pluripotent stem cells in hematology: current and future applications", Blood Cancer Journal, 2014, e211, pp. 1-8, vol. 4.

Fonfara et al., "Phylogeny of Cas9 determines functional exchangeability of dual-RNA and Cas9 among orthologous type II CRISPR-Cas systems", Nucleic Acids Research, 2014, pp. 2577-2590, vol. 42, No. 4.

Fucini et al., "Adenosine Modification May Be Preferred for Reducing siRNA Immune Stimulation", Nucleic Acid Therapeutics, 2012, pp. 205-210, vol. 22, No. 3.

Gaglione et al., "Recent Progress in Chemically Modified siRNAs", Mini-Reviews in Medicinal Chemistry, 2010, pp. 578-595, vol. 10, No. 7.

Gebeyehu et al., "Novel biotinylated nucleotide—analogs for labeling and colorimetric detecton of DNA", Nucleic Acids Research, 1987, pp. 4513-4534, vol. 15, No. 11.

Gentner et al., "Exploiting microRNA regulation for genetic engineering", Tissue Antigens, 2012, pp. 393-403, vol. 80.

Grimm et al., "In Vitro and In Vivo Gene Therapy Vector Evolution via Multispecies Interbreeding and Retargeting of Adeno-Associated Viruses", Journal of Virology, 2008, pp. 5887-5911, vol. 82, No. 12.

Grimson et al., "MicroRNA Targeting Specificity in Mammals: Determinants beyond Seed Pairing", Molecular Cell, 2007, pp. 91-105, vol. 27.

Guilinger et al., "Fusion of catalytically inactive Cas9 to Fokl nuclease improves the specificity of genome modification", Nature Biotechnology, 2014, pp. 577-582, vol. 32, No. 6.

Hafez et al., "Homing endonucleases: DNA scissors on a mission", Genome, 2012, pp. 553-569, vol. 55.

Heasman, "Morpholino Oligos: Making Sense of Antisense?", Developmental Biology, 2002, pp. 209-214, vol. 243.

Hermonat et al., "Use of adeno-associated virus as a mammalian DNA cloning vector: Transduction of neomycin resistance into mammalian tissue culture cells", PNAS, 1984, pp. 6466-6470, vol. 81.

Herranz et al., "MicroRNAs and gene regulatory networks: managing the impact of noise in biological systems", Genes & Development, 2010, pp. 1339-1344, vol. 24.

Hoyng et al., "Gene therapy and peripheral nerve repair: a perspective", Frontiers in Molecular Neuroscience, 2015, pp. 1-9, vol. 8, No. 32.

Hu et al., "Physiological Roles of Asialoglycoprotein Receptors (ASGPRs) Variants and Recent Advances in Hepatic-Targeted Delivery of Therapeutic Molecules Via ASGPRs", Protein & Peptide Letters, 2014, pp. 1025-1030, vol. 21, No. 10.

Huangfu et al., "Induction of pluripotent stem cells by defined factors is greatly improved by small-molecule compounds", Nature Biotechnology, 2008, pp. 795-797, vol. 26, No. 7.

Jinek et al., "A Programmable Dual-RNA-Guided DNA Endonuclease in Adaptive Bacterial Immunity", Science, 2012, pp. 816-821, vol. 337.

Judge et al., "Design of Noninflammatory Synthetic siRNA Mediating Potent Gene Silencing in Vivo", Molecular Therapy, 2006, pp. 494-505, vol. 13, No. 3.

Judge et al., "Overcoming the Innate Immune Response to Small Interfering RNA", Human Gene Therapy, 2008, pp. 1-14, vol. 19.

Kabanov et al., "A new class of antivirals: antisense oligonucleotides combined with a hydrophobic substituent effectively inhibit influenza virus reproduction and systhesis of virus-specific proteins in MDCK cells", FEBS Letters, 1990, pp. 327-330, vol. 259, No. 2.

Kanasty et al., "Action and Reaction: The Biological Response to siRNA and Its Delivery Vehicles", Molecular Therapy, 2012, pp. 513-524, vol. 20, No. 3.

Kariko et al., "Suppression of RNA Recognition by Toll-like Receptors: The Impact of Nucleoside Modification and the Evolutionary Origin of RNA", Immunity, 2005, pp. 165-175, vol. 23.

Kent et al., "Mechanism of Microhomology-Mediated End-Joining Promoted by Human DNA Polymerase Theta", Mature Structural & Molecular Biology, 2015, pp. 230-237, vol. 22, No. 3.

Kleinstiver et al., "The I-Tevl Nuclease and Linker Domains Contribute to the Specificity of Monomeric TALENs", Genes/Genomes/Genetics, 2014, pp. 1155-1165, vol. 4.

Kole et al., "RNA therapeutics: beyond RNA interference and antisense oligonucleotides", Nature Reviews/Drug Discovery, 2012, pp. 125-140, vol. 11.

Kormann et al., "Expression of therapeutic proteins after delivery of chemically modified mRNA in mice", Nature Biotechnology, 2011, pp. 154-157, vol. 29.

Lacerra et al., "Restoration of hemoglobin A synthesis in erythroid cells from peripheral blood of thalassemic patients", PNAS, 2000, pp. 9591-9596, vol. 97, No. 17.

Ladak et al., "Differentiation of mesenchymal stem cells to support peripheral nerve regeneration in a rat model", Experimental Neurology, 2011, pp. 242-252, vol. 228.

Landgraf et al., "A Mammalian microRNA Expression Atlas Based on Small RNA Library Sequencing", Cell, 2007, pp. 1401-1414, vol. 129.

Lebkowski et al., "Adeno-Associated Virus: a Vector System for Efficient Introduction and Integration of DNA into a Variety of Mammalian Cell Types", Molecular and Cellular Biology, 1988, pp. 3988-3996, vol. 8, No. 10.

Letsinger et al., "Cholesteryl-conjugated oligonucleotides: Synthesis, properties, and activity as inhibitors of replication of human immunodeficiency virus in cell culture", PNAS, 1989, pp. 6553-6556, vol. 86.

Li et al., "Modularly assembled designer TAL effector nucleases for targeted gene knockout and gene replacement in eukaryotes", Nucleic Acids Research, 2011, pp. 6315-6325, vol. 39, No. 14.

Liu et al., "Validated Zinc Finger Protein Designs for All 16 GNN DNA Triplet Targets", The Journal of Biological Chemistry, 2002, pp. 3850-3856, vol. 277, No. 6.

Bennett D.L.H., et al., "Painful and painless channelopathies," Lancet Neurology, Jun. 2014, vol. 13, pp. 587-599.

Examination Report No. 1 for Australian Patent Application No. 2017292169, dated Aug. 23, 2021, 4 pages.

Examination Report No. 1 for Australian Patent Application No. 2017292173, dated Aug. 24, 2021, 4 pages.

Fertleman C.R., et al., "SCN9A Mutations in Paroxysmal Extreme Pain Disorder: Allelic Variants Underlie Distinct Channel Defects and Phenotypes," Neuron, 2006, vol. 52, pp. 767-774.

Hendel A., et al., "Chemically modified guide RNAs enhance CRISPR-Cas genome editing in human primary cells," Mature Biotechnology, vol. 33(9), Sep. 2015, 7 pages.

Huang J., et al., "Small-Fiber Neuropathy Nav1.8 Mutation Shifts Activation to Hyperpolarized Potentials and Increases Excitability of Dorsal Root Ganglion Neurons," The Journal of Neuroscience, Aug. 28, 2013, vol. 33(35), pp. 14087-14097.

International Search Report and Written Opinion for International Application No. PCT/IB2017/054081, dated Nov. 3, 2017, 10 pages.

International Preliminary Report on Patentability for International Application No. PCT/IB2017/054081, dated Jan. 17, 2019, 7 pages.

International Preliminary Report on Patentability for International Application No. PCT/IB2017/054086, dated Jan. 17, 2019, 7 pages.

Li H.L., et al., "Precise Correction of the Dystrophin Gene in Duchenne Muscular Dystrophy Patient Induced Pluripotent Stem Cells by TALEN and CRISPR-Cas9," Stem Cell Reports, Jan. 13, 2015, vol. 4, pp. 143-154.

Office Action for European Application No. 17754196.8, dated Feb. 9, 2021, 5 pages.

(56) References Cited

OTHER PUBLICATIONS

Office Action for European Application No. 17754197.6, dated Aug. 6, 2021, 5 pages.
Office Action for Japanese Patent Application No. 2019-500268, dated Jul. 27, 2021, 18 pages.
Office Action for Japanese Patent Application No. 2019-500283, dated Aug. 10, 2021, 7 pages.

Rannals M.D., et al., "Psychiatric Risk Gene Transcription Factor 4 Regulates Intrinsic Excitability of Prefrontal Neurons via Repression of SCN10a and KCNQ1," Neuron, Apr. 6, 2016, vol. 90, pp. 43-55.
Schroeder C.L., et al., "Rational Design and Synthesis of a Novel Membrane Binding NaV1.8 Selective Inhibitor with in vivo Activity in Pain Models," Biophysical Journal, Feb. 28, 2016, vol. 110(3), p. 33a.

* cited by examiner

FIGURE 2A

| SEQ ID NO. | Name | Sequence | Indel | R2 |
|---|---|---|---|---|
| 46832 | SCN9A_Int13_Int14_T4 | TGTGCAAATCTGTACCACCA | 98.5 | 0.9854 |
| 49122 | SCN9A_Int5_Int6_T10 | CAAATAGTTGGAGTTATGAG | 97.5 | 0.975 |
| 49431 | SCN9A_Int2_Int5_T31 | CAGCAGTTTACCTTTCTACA | 96.9 | 0.9844 |
| 47474 | SCN9A_Int10_Int11_T22 | CACCTATTAGCATAACAACA | 96.7 | 0.9848 |
| 47446 | SCN9A_Int10_Int11_T6 | TATGCCCTTCGACACCAAGG | 96.4 | 0.9869 |
| 28779 | SCN9A_Int8_Int9_T21 | GAGCTTTGACACTTCAGCT | 96.4 | 0.9861 |
| 29821 | SCN9A_Int6_Int7_T3 | CAGGCCTGAAGACAATTGTA | 96 | 0.9712 |
| 28146 | SCN9A_Int10_Int11_T17 | GTGAAAGATGTCCTGTCCTA | 95.9 | 0.9618 |
| 49436 | SCN9A_Int2_Int5_T35 | GCCATCAGACTCCAGCAATG | 95.9 | 0.9683 |
| 47224 | SCN9A_Int11_Int12_T26 | CTGGCAGAAGCTGTCCATTG | 95.6 | 0.9894 |
| 47462 | SCN9A_Int10_Int11_T12 | CCGCTGCCGCTGCAATTGCC | 95.6 | 0.974 |
| 47240 | SCN9A_Int11_Int12_T3 | CGTTCACCGGCAGCATTGGT | 95.5 | 0.9825 |
| 27323 | SCN9A_Int14_int15_T1 | AGTTCTGCGATCATTCAGAC | 95.1 | 0.9812 |
| 27522 | SCN9A_Int13_Int14_T2 | GGAACACCACCCAATGACTG | 95 | 0.9498 |
| 27893 | SCN9A_Int11_Int12_T20 | TAGGTCCCCACCAATGCTGC | 94.8 | 0.9897 |
| 47261 | SCN9A_Int11_Int12_T28 | AAGGAGCCACGAATGCTGAG | 94.6 | 0.9866 |
| 28137 | SCN9A_Int10_Int11_T21 | GCCCAACCAGGCAATTGCAG | 94.4 | 0.9559 |
| 49367 | SCN9A_Int2_Int5_T8 | CCAGTCCGGTGGGTTATTCA | 94.3 | 0.9456 |
| 47232 | SCN9A_Int11_Int12_T8 | GGCTGAGCGTCCATCAACCA | 94.1 | 0.9419 |
| 47445 | SCN9A_Int10_Int11_T7 | GCCTATGCCCTTCGACACCA | 93.9 | 0.9884 |
| 49313 | SCN9A_Int2_Int5_T38 | TATATTGGAGGATGGCTGTT | 93.9 | 0.9718 |
| 47267 | SCN9A_Int11_Int12_T24 | ATAAATACCACTGAACCCAC | 93.8 | 0.9543 |
| 30622 | SCN9A_Int1_Int2_T9 | CCATCCAGGCCTCTTATGTG | 93.8 | 0.9864 |
| 47231 | SCN9A_Int11_Int12_T5 | GGGCTGAGCGTCCATCAACC | 93.3 | 0.9599 |

FIGURE 2B

| | | | | |
|---|---|---|---|---|
| 26766 | SCN9A_Int16_Int17_T10 | TGACAGTGCCAATTGCACCT | 93 | 0.9654 |
| 28139 | SCN9A_Int10_Int11_T4 | GTTAACGTCTTGGCCCAACC | 92.4 | 0.989 |
| 46079 | SCN9A_Int16_Int17_T9 | TAGGTTTAGGACCTATATCA | 92 | 0.9684 |
| 48091 | SCN9A_Int8_Int9_T18 | CTCAAGGTTTCTTCTATAGG | 91.2 | 0.9861 |
| 46833 | SCN9A_Int13_Int14_T1 | GCAAATCTGTACCACCAAGG | 91.1 | 0.9634 |
| 26765 | SCN9A_Int16_Int17_T16 | GACAGTGCCAATTGCACCTG | 91 | 0.955 |
| 27876 | SCN9A_Int11_Int12_T27 | GCCAGAGGTGATAATAGATA | 90.8 | 0.9079 |
| 47241 | SCN9A_Int11_Int12_T18 | GTTCACCGGCAGCATTGGTG | 90.7 | 0.9566 |
| 47248 | SCN9A_Int11_Int12_T22 | GCGTCGCTCCTGGGGTCTGT | 90.7 | 0.9566 |
| 30051 | SCN9A_Int2_Int5_T34 | CCCAATGGAATCTTGTGTTT | 90.7 | 0.9414 |
| 30111 | SCN9A_Int2_Int5_T18 | TATGACCATGAATAACCCAC | 90.4 | 0.9198 |
| 28760 | SCN9A_Int8_Int9_T16 | TGTTAAGAGCCTGTATTAGG | 89.8 | 0.9789 |
| 28085 | SCN9A_Int10_Int11_T23 | ATAGGCGAGCACATGAAAAG | 89.6 | 0.9545 |
| 27254 | SCN9A_Int15_Int16_T19 | AAGATCATTGGTAACTCAGT | 89.4 | 0.9459 |
| 30163 | SCN9A_Int2_Int5_T9 | GATAGATGCGTTGATGACAT | 89.3 | 0.9015 |
| 49303 | SCN9A_Int2_Int5_T44 | CCTAAACACAAGATTCCATT | 89 | 0.9199 |
| 28083 | SCN9A_Int10_Int11_T2 | GAGGTTGTCTACCCCCAATC | 88.8 | 0.9471 |
| 49344 | SCN9A_Int2_Int5_T30 | GCAGGTTAATATCATAGAGG | 88.6 | 0.9133 |
| 47245 | SCN9A_Int11_Int12_T2 | GTTACTGCTGCGTCGCTCCT | 87.6 | 0.9615 |
| 48090 | SCN9A_Int8_Int9_T22 | ACTCAAGGTTTCTTCTATAG | 87.3 | 0.9635 |
| 28132 | SCN9A_Int10_Int11_T16 | CGGCTGAATATACAAGTATT | 87.1 | 0.9525 |
| 27328 | SCN9A_Int14_Int15_T2 | GGAGCTCTTTCTAGCAGATG | 86.7 | 0.8798 |
| 46078 | SCN9A_Int16_Int17_T8 | ATAGGTTTAGGACCTATATC | 86.5 | 0.9711 |
| 28773 | SCN9A_Int8_Int9_T7 | GCTAATGACCCAAGATTACT | 86.5 | 0.9112 |
| 46496 | SCN9A_Int15_Int16_T12 | ACATCTGGTTACATACCACC | 86.1 | 0.8996 |
| 27885 | SCN9A_Int11_Int12_T23 | GGTGTGGTCTCCCTGGTTGA | 86.1 | 0.9434 |

FIGURE 2C

| ID | Name | Sequence | Value1 | Value2 |
|---|---|---|---|---|
| 29928 | SCN9A_Int5_Int6_T2 | AATACCTTGACTAAAGGCTC | 86 | 0.8809 |
| 27933 | SCN9A_Int11_Int12_T7 | CAGTCACCACTCAGCATTCG | 85.9 | 0.9717 |
| 46039 | SCN9A_Int16_Int17_T2 | TTTTCCAAATCGGATTCCCC | 85.2 | 0.952 |
| 47439 | SCN9A_Int10_Int11_T10 | CAATTTGGGTGGTACCTGAT | 84 | 0.9863 |
| 28774 | SCN9A_Int8_Int9_T1 | GGCTAATGACCCAAGATTAC | 83.9 | 0.9273 |
| 47455 | SCN9A_Int10_Int11_T24 | AGCACTTTTAGAGCTCAGTT | 83.8 | 0.9811 |
| 30020 | SCN9A_Int2_Int5_T24 | TATGAAAGCTAGTCATTGAT | 83.5 | 0.8574 |
| 47236 | SCN9A_Int11_Int12_T15 | CTGTGCATTTTCCCGTTCAC | 83.1 | 0.9042 |
| 28089 | SCN9A_Int10_Int11_T3 | ACCTTGGTGTCGAAGGGCAT | 83.1 | 0.847 |
| 26813 | SCN9A_Int16_Int17_T14 | ATAGGTCCTAAACCTATTTC | 82.8 | 0.9369 |
| 47464 | SCN9A_Int10_Int11_T9 | GCCGCTGCAATTGCCTGGTT | 81.7 | 0.8389 |
| 28091 | SCN9A_Int10_Int11_T8 | GTTTCCACCTTGGTGTCGAA | 81.3 | 0.9816 |
| 29908 | SCN9A_Int5_Int6_T11 | AGTAATTGGTGTGAAGCATT | 81 | 0.8373 |
| 27892 | SCN9A_Int11_Int12_T12 | CCACCAATGCTGCCGGTGAA | 80.9 | 0.9922 |
| 28776 | SCN9A_Int8_Int9_T15 | GGGCCTTCTTAGCCTTGTTT | 80.9 | 0.827 |
| 28783 | SCN9A_Int8_Int9_T17 | ATTGGCAGAAACCCTGATTA | 80.9 | 0.934 |
| 27252 | SCN9A_Int15_Int16_T13 | GATCATTGGTAACTCAGTAG | 80.5 | 0.8174 |
| 29930 | SCN9A_Int5_Int6_T12 | GTAGAAAATACCTTGACTAA | 80.5 | 0.897 |
| 47625 | SCN9A_Int9_Int10_T1 | CCAGCAGCACGCAGCGTCTA | 80.2 | 0.9761 |
| 49945 | SCN9A_Int1_Int2_T16 | AGCAATGCGTTGTTCAATGA | 79.8 | 0.9753 |
| 30106 | SCN9A_Int2_Int5_T10 | ACCAAAAATGTCGAGTAAGT | 79.7 | 0.8658 |
| 48060 | SCN9A_Int8_Int9_T12 | TTGGGTCATTAGCCTAAACA | 79.6 | 0.9502 |
| 29831 | SCN9A_Int6_Int7_T8 | GATATAATGCATGACTTTCT | 79.5 | 0.8465 |
| 47239 | SCN9A_Int11_Int12_T10 | CCGTTCACCGGCAGCATTGG | 79.3 | 0.9666 |
| 49355 | SCN9A_Int2_Int5_T41 | TCATAAATGCAGTAACTTCC | 78.9 | 0.8446 |
| 26774 | SCN9A_Int16_Int17_T7 | CAGCGTGGACAAACACTTGA | 78.8 | 0.986 |

FIGURE 2D

| | | | | |
|---|---|---|---|---|
| 30050 | SCN9A_Int2_Int5_T15 | GTGTTTAGGTACACTTTTAC | 78.8 | 0.8501 |
| 47246 | SCN9A_Int11_Int12_T9 | TTACTGCTGCGTCGCTCCTG | 78.6 | 0.9339 |
| 27250 | SCN9A_Int15_Int16_T16 | GGTAACTCAGTAGGGGCTCT | 77.8 | 0.9081 |
| 49124 | SCN9A_Int5_Int6_T9 | ACACCAATTACTTCTTACCT | 77 | 0.7704 |
| 30053 | SCN9A_Int2_Int5_T22 | TTTCACATCTAGTATCCCAA | 76.9 | 0.8784 |
| 49362 | SCN9A_Int2_Int5_T11 | ACCCACTTACTCGACATTTT | 75.9 | 0.9543 |
| 47238 | SCN9A_Int11_Int12_T11 | TTCCCGTTCACCGGCAGCAT | 75.8 | 0.9612 |
| 49418 | SCN9A_Int2_Int5_T45 | AAGCAGGTGTGGCATTGAAA | 75.4 | 0.7977 |
| 27544 | SCN9A_Int13_Int14_T3 | ATGCCTGACTGATTTGTATC | 74.9 | 0.9498 |
| 46080 | SCN9A_Int16_Int17_T5 | GTTAGGACCTATATCAGGG | 74.8 | 0.982 |
| 26775 | SCN9A_Int16_Int17_T15 | CAGTGGTTTTGGAAGCAGCG | 73.7 | 0.9893 |
| 30079 | SCN9A_Int2_Int5_T4 | ATTTTTGATAGAAGCAATGT | 73.6 | 0.9499 |
| 48052 | SCN9A_Int8_Int9_T8 | TTCTCTTGGTACTCACCTGT | 73.1 | 0.8926 |
| 46081 | SCN9A_Int16_Int17_T6 | TTTAGGACCTATATCAGGGT | 72.6 | 0.8862 |
| 49424 | SCN9A_Int2_Int5_T40 | ATACTATGAAAGTCTGCAGG | 71.9 | 0.8943 |
| 47440 | SCN9A_Int10_Int11_T14 | AATTTGGGTGGTACCTGATT | 71.6 | 0.922 |
| 49331 | SCN9A_Int2_Int5_T36 | TGTGTAACATGTCTAAGAAC | 70.3 | 0.8103 |
| 30612 | SCN9A_Int1_Int2_T5 | ATGGCAATGTTGCCTCCCCC | 70.1 | 0.9169 |
| 47441 | SCN9A_Int10_Int11_T18 | ATTTGGGTGGTACCTGATTG | 69.9 | 0.9539 |
| 47626 | SCN9A_Int9_Int10_T7 | ACGCAGCGTCTAGGGAAAAA | 69.6 | 0.9564 |
| 49314 | SCN9A_Int2_Int5_T23 | GGAGGATGGCTGTTGGGTTA | 69.4 | 0.7808 |
| 27530 | SCN9A_Int13_Int14_T5 | TCTGGAATTGCTCTCCATAT | 67.9 | 0.8398 |
| 48081 | SCN9A_Int8_Int9_T14 | TTATAGGTGAGAGTGTCTTC | 67.9 | 0.7989 |
| 30065 | SCN9A_Int2_Int5_T42 | TAGACCTATTGTAGTTTAAT | 67.9 | 0.8691 |
| 46040 | SCN9A_Int16_Int17_T4 | TCGGATTCCCCAGGTGCAAT | 67.8 | 0.9378 |
| 49962 | SCN9A_Int1_Int2_T24 | AGCTCCTCACATAAGAGGCC | 67.2 | 0.9019 |

FIGURE 2E

| | | | | |
|---|---|---|---|---|
| 49976 | SCN9A_Int1_Int2_T14 | CTAGAATTATCAGCTTGTTA | 66.8 | 0.9416 |
| 27248 | SCN9A_Int15_Int16_T15 | AGGTAACCTCACCTTAGTGT | 64.9 | 0.9318 |
| 29814 | SCN9A_Int6_Int7_T2 | CTGAGTGTGTTTGCACTAAT | 64.6 | 0.9659 |
| 30162 | SCN9A_Int2_Int5_T25 | TGACATTGGAACCACATTGC | 64.1 | 0.6897 |
| 49302 | SCN9A_Int2_Int5_T33 | ACCTAAACACAAGATTCCAT | 62.5 | 0.7737 |
| 49366 | SCN9A_Int2_Int5_T1 | CATTTTTGGTCCAGTCCGGT | 62.5 | 0.8884 |
| 26764 | SCN9A_Int16_Int17_T1 | TGCACCTGGGGAATCCGATT | 62.2 | 0.8398 |
| 46082 | SCN9A_Int16_Int17_T11 | TTAGGACCTATATCAGGGTG | 60.9 | 0.9655 |
| 49048 | SCN9A_Int6_Int7_T1 | AAGCCCCTACAATTGTCTTC | 60.6 | 0.7797 |
| 28788 | SCN9A_Int8_Int9_T11 | CGTGTGTAGTCAGTGTCCAG | 60.3 | 0.663 |
| 47633 | SCN9A_Int9_Int10_T10 | CATGAGCAAATCTGACAGTT | 60.2 | 0.9542 |
| 49290 | SCN9A_Int2_Int5_T28 | CAAAATCCAGCCAGTTCCAC | 58 | 0.6231 |
| 27222 | SCN9A_Int15_Int16_T17 | TACATGATGGTCATGGTCAT | 57.5 | 0.859 |
| 30107 | SCN9A_Int2_Int5_T14 | GACCAAAAATGTCGAGTAAG | 57.3 | 0.8715 |
| 27336 | SCN9A_Int14_Int15_T3 | ATGAGTATTTCCAAGTAGGC | 56.2 | 0.9135 |
| 49142 | SCN9A_Int5_Int6_T3 | CTTACCTGAGCCTTTAGTCA | 55.5 | 0.8324 |
| 48073 | SCN9A_Int8_Int9_T4 | TTCACACAGGTGTACCCCTC | 55.3 | 0.8246 |
| 28305 | SCN9A_Int9_Int10_T9 | CTTTGTCGTAGTGATTTTCC | 55 | 0.9279 |
| 49145 | SCN9A_Int5_Int6_T4 | CAAGGTATTTTCTACGTTTG | 53.9 | 0.9381 |
| 30061 | SCN9A_Int2_Int5_T32 | CTCCAATATATGTCTTCCAG | 52.6 | 0.7103 |
| 47463 | SCN9A_Int10_Int11_T11 | TGCCGCTGCAATTGCCTGGT | 52.1 | 0.7771 |
| 48054 | SCN9A_Int8_Int9_T5 | TGGTACTCACCTGTTGGTAA | 52 | 0.9139 |
| 49365 | SCN9A_Int2_Int5_T6 | ACATTTTTGGTCCAGTCCGG | 51.6 | 0.664 |
| 27253 | SCN9A_Int15_Int16_T18 | AGATCATTGGTAACTCAGTA | 51.3 | 0.8976 |
| 49352 | SCN9A_Int2_Int5_T37 | AGCAAGCATATAACATGGGA | 51.2 | 0.6484 |
| 30110 | SCN9A_Int2_Int5_T2 | CCATGAATAACCCACCGGAC | 50.7 | 0.8218 |

FIGURE 2F

| | | | | |
|---|---|---|---|---|
| 27887 | | | | |
| | SCN9A_Int11_Int12_T14 | TGCTGTGGACTGCAACGGTG | 49.8 | 0.9532 |
| 47243 | | | | |
| | SCN9A_Int11_Int12_T17 | TTGGTGGGGACCTACTGGCT | 49.6 | 0.9388 |
| 27868 | | | | |
| | SCN9A_Int11_Int12_T25 | TTACATAGCTCAGGCATGGC | 48.5 | 0.7899 |
| 27891 | | | | |
| | SCN9A_Int11_Int12_T6 | CACCAATGCTGCCGGTGAAC | 48.4 | 0.8152 |
| 46834 | | | | |
| | SCN9A_Int13_Int14_T7 | CCAAGGTGGACATTTTTGTC | 48.2 | 0.9607 |
| 30043 | | | | |
| | SCN9A_Int2_Int5_T5 | TCACTTTTCTTCGTGACCCG | 47.6 | 0.9582 |
| 49944 | | | | |
| | SCN9A_Int1_Int2_T2 | CAGCAATGCGTTGTTCAATG | 46 | 0.9926 |
| 49316 | | | | |
| | SCN9A_Int2_Int5_T29 | ACACCCTATTAAACTACAAT | 45.3 | 0.9238 |
| 26767 | | | | |
| | SCN9A_Int16_Int17_T3 | GTGACAGTGCCAATTGCACC | 44.1 | 0.9752 |
| 28273 | | | | |
| | SCN9A_Int9_Int10_T3 | GAGGCTCTGCGGTATATGCT | 44 | 0.4837 |
| 47242 | | | | |
| | SCN9A_Int11_Int12_T13 | CAGCATTGGTGGGGACCTAC | 43.8 | 0.9894 |
| 47624 | | | | |
| | SCN9A_Int9_Int10_T2 | GCCAGCAGCACGCAGCGTCT | 41.1 | 0.9805 |
| 29811 | | | | |
| | SCN9A_Int6_Int7_T6 | ATTGGACTACAGCTGTTCAT | 40.8 | 0.429 |
| 49422 | | | | |
| | SCN9A_Int2_Int5_T27 | TCAATACTATGAAAGTCTGC | 40.1 | 0.9581 |
| 28081 | | | | |
| | SCN9A_Int10_Int11_T1 | TGCTAAATGTGTATCACCCG | 39.9 | 0.9746 |
| 46050 | | | | |
| | SCN9A_Int16_Int17_T17 | TGCTCATTTCAGCAAGTGTA | 38.5 | 0.9915 |
| 27870 | | | | |
| | SCN9A_Int11_Int12_T16 | AAGGACGTTTTACATAGCTC | 36.8 | 0.3684 |
| 47472 | | | | |
| | SCN9A_Int10_Int11_T15 | ATCCTAGGAAACCCTAGGAC | 36.6 | 0.9894 |
| 49952 | | | | |
| | SCN9A_Int1_Int2_T27 | TGGACAAAGCTCTGAGGTCC | 34.9 | 0.9874 |
| 28780 | | | | |
| | SCN9A_Int8_Int9_T9 | CGAGCTTTGACACTTTCAGC | 32.2 | 0.9531 |
| 46099 | | | | |
| | SCN9A_Int16_Int17_T13 | AAGTACACTTTTCCGAATAT | 29.8 | 0.9835 |
| 49143 | | | | |
| | SCN9A_Int5_Int6_T1 | GTCAAGGTATTTTCTACGTT | 27.6 | 0.8857 |
| 28150 | | | | |
| | SCN9A_Int10_Int11_T19 | CACCATGTTGTTATGCTAAT | 26 | 0.9945 |
| 27873 | | | | |
| | SCN9A_Int11_Int12_T4 | CAACTTCTGATGACAGCGTA | 25.8 | 0.9859 |
| 47244 | | | | |
| | SCN9A_Int11_Int12_T1 | TGTTACTGCTGCGTCGCTCC | 25.6 | 0.9923 |
| 30041 | | | | |
| | SCN9A_Int2_Int5_T7 | TCGTGACCCGTGGAACTGGC | 23.4 | 0.9831 |

FIGURE 2G

| 47604 | | | | |
|---|---|---|---|---|
| | SCN9A_Int9_Int10_T8 | TAGCTTCTTCAATGTTTGCC | 22.1 | 0.9675 |
| 49357 | | | | |
| | SCN9A_Int2_Int5_T43 | AAATGCAGTAACTTCCTGGC | 18.5 | 0.9816 |
| 28275 | | | | |
| | SCN9A_Int9_Int10_T5 | AATGCAAACGGTTACAACAG | 17.3 | 0.2165 |
| 28092 | | | | |
| | SCN9A_Int10_Int11_T5 | AGTTTCCACCTTGGTGTCGA | 16.1 | 0.9885 |
| 49283 | | | | |
| | SCN9A_Int2_Int5_T19 | CCCCAGAGGTTTGCTGTTAT | 12.2 | 0.9888 |
| 28141 | | | | |
| | SCN9A_Int10_Int11_T13 | TCATTTAAGTGTTAACGTCT | 10.2 | 0.9934 |
| 30628 | | | | |
| | SCN9A_Int1_Int2_T20 | TTTAATGGGCCTTTCTTGGC | 9.4 | 0.9392 |
| 46066 | | | | |
| | SCN9A_Int16_Int17_T12 | ATCTGGAGGTTGTTTGCATC | 8.7 | 0.9932 |
| 49364 | | | | |
| | SCN9A_Int2_Int5_T12 | TCGACATTTTTGGTCCAGTC | 8.5 | 0.989 |
| 28307 | | | | |
| | SCN9A_Int9_Int10_T4 | CCCTAGACGCTGCGTGCTGC | 5.1 | 0.9929 |
| 28143 | | | | |
| | SCN9A_Int10_Int11_T20 | TCCTAGGGTTTCCTAGGATT | 4.1 | 0.9928 |

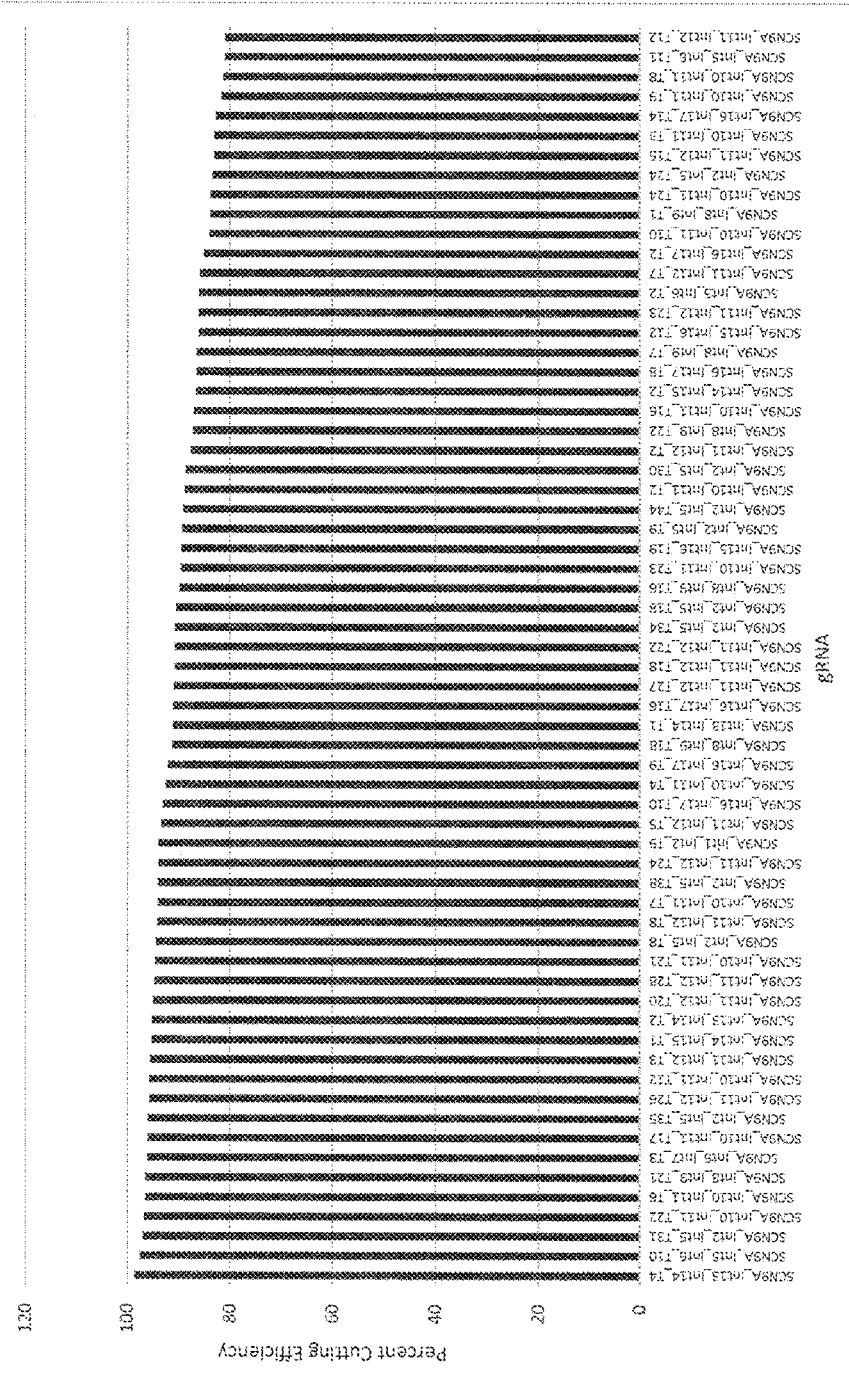

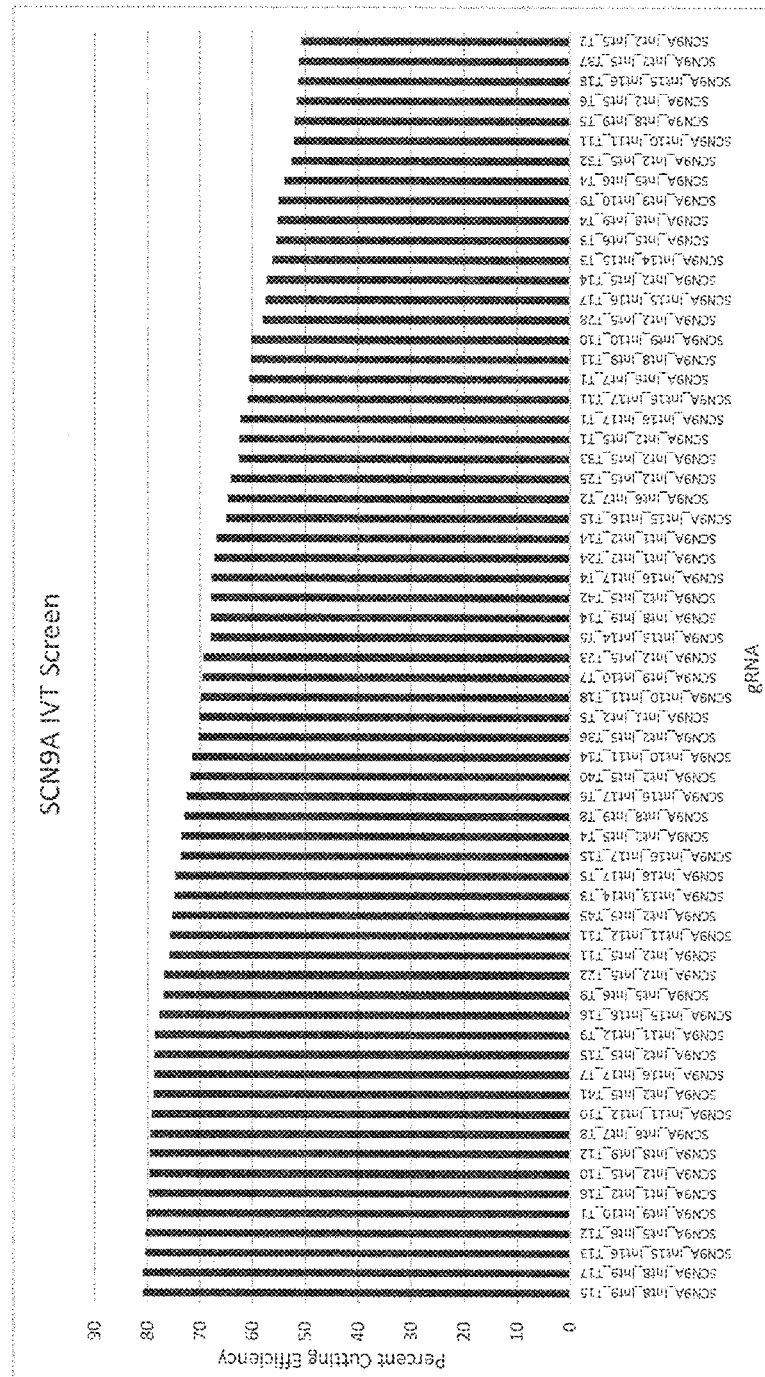

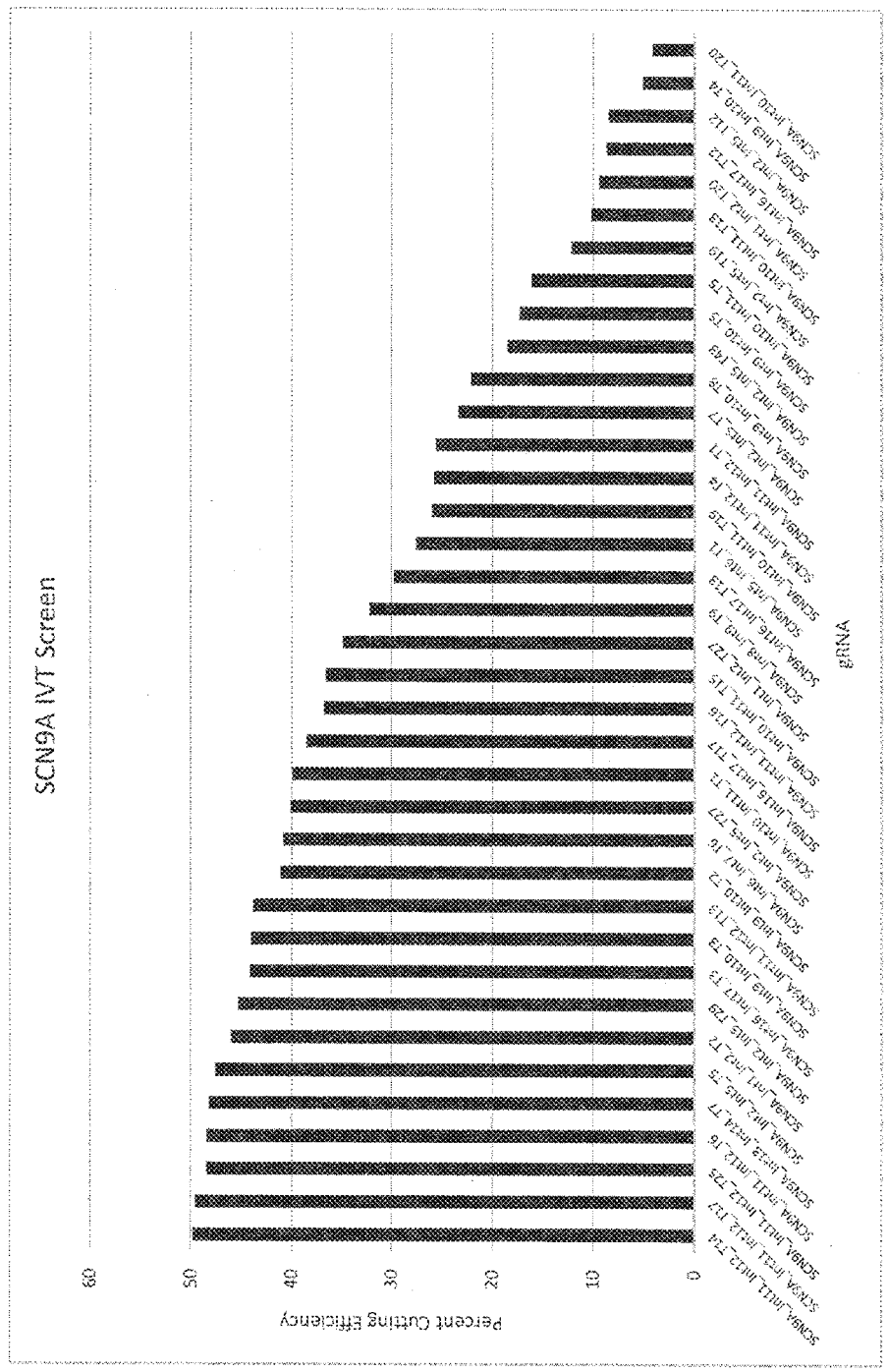

MATERIALS AND METHODS FOR TREATMENT OF PAIN RELATED DISORDERS

RELATED APPLICATIONS

This application is a national stage filing under 35 U.S.C. § 371 of international application number PCT/IB2017/054086, filed Jul. 6, 2017, which claims the benefit of U.S. Provisional Application No. 62/358,763 filed Jul. 6, 2016 and U.S. Provisional Application No. 62/461,874 filed Feb. 22, 2017, each of which are incorporated herein by reference in its entirety.

FIELD

The present disclosure relates to the field of gene editing and specifically to the alteration of the Sodium Voltage-Gated Channel Alpha Subunit 9 (SCN9A) gene.

INCORPORATION BY REFERENCE OF SEQUENCE LISTING

This application contains a Sequence Listing which has been filed electronically in ASCII format and is hereby incorporated herein by reference in its entirety. This ASCII copy, created on Dec. 31, 2018, is named C154270022US02-SEQ-YJC and is 48,746 kB in size.

BACKGROUND

Genome engineering refers to the strategies and techniques for the targeted, specific modification of the genetic information (genome) of living organisms. Genome engineering is a very active field of research because of the wide range of possible applications, particularly in the areas of human health. For example, genome engineering can be used to alter (e.g., correct or knock-out) a gene carrying a harmful mutation or to explore the function of a gene. Early technologies developed to insert a transgene into a living cell were often limited by the random nature of the insertion of the new sequence into the genome. Random insertions into the genome may result in disrupting normal regulation of neighboring genes leading to severe unwanted effects. Furthermore, random integration technologies offer little reproducibility, as there is no guarantee that the sequence would be inserted at the same place in two different cells. Recent genome engineering strategies, such as zinc finger nucleases (ZFNs), transcription activator like effector nucleases (TALENs), homing endonucleases (HEs) and MegaTALs, enable a specific area of the DNA to be modified, thereby increasing the precision of the alteration compared to early technologies. These newer platforms offer a much larger degree of reproducibility, but still have their limitations.

Despite efforts from researchers and medical professionals worldwide who have been trying to address genetic disorders, and despite the promise of genome engineering approaches, there still remains a critical need for developing safe and effective treatments involving SCN9A related indications.

By using genome engineering tools to create permanent changes to the genome that can address the SCN9A related disorders or conditions with as few as a single treatment, the resulting therapy may completely remedy certain SCN9A related indications and/or diseases.

SUMMARY

Provided herein are cellular, ex vivo and in vivo methods for creating permanent changes to the genome by introducing one or more insertions, deletions or mutations of at least one nucleotide within or near the Sodium Voltage-Gated Channel Alpha Subunit 9 (SCN9A) gene or other DNA sequences that encode regulatory elements of the SCN9A gene by genome editing and reducing or eliminating Sodium Voltage-Gated Channel Alpha Subunit 9 (SCN9A) gene products, which can be used to treat pain. Also provided performing herein are components and compositions, and vectors for performing such methods.

Provided herein is a method for editing a Sodium Voltage-Gated Channel Alpha Subunit 9 (SCN9A) gene in a cell by genome editing comprising: introducing into the cell one or more deoxyribonucleic acid (DNA) endonucleases to effect one or more single-strand breaks (SSBs) or double-strand breaks (DSBs) within or near the SCN9A gene or SCN9A regulatory elements that results in one or more permanent insertions, deletions or mutations of at least one nucleotide within or near the SCN9A gene, thereby reducing or eliminating the expression or function of SCN9A gene products.

Also provided herein is an ex vivo method for treating a patient having an SCN9A related condition or disorder comprising: editing a patient specific induced pluripotent stem cell (iPSC) within or near a Sodium Voltage-Gated Channel Alpha Subunit 9 (SCN9A) gene or other DNA sequences that encode regulatory elements of the SCN9A gene; differentiating the edited iPSC into a neuron of the peripheral nervous system; and administering the neuron of the peripheral nervous system to the patient.

In some aspects, the editing step comprises: introducing into the iPSC one or more deoxyribonucleic acid (DNA) endonucleases to effect one or more single-strand breaks (SSBs) or double-strand breaks (DSBs) within or near the SCN9A gene or SCN9A regulatory elements that results in one or more permanent insertions, deletions or mutations of at least one nucleotide within or near the SCN9A gene, thereby reducing or eliminating the expression or function of SCN9A gene products.

Also provided herein is an ex vivo method for treating a patient having an SCN9A related condition or disorder comprising: editing a mesenchymal stem cell within or near a Sodium Voltage-Gated Channel Alpha Subunit 9 (SCN9A) gene or other DNA sequences that encode regulatory elements of the SCN9A gene; differentiating the edited mesenchymal stem cell into a neuron of the peripheral nervous system; and administering the neuron of the peripheral nervous system to the patient.

In some aspects, the editing step comprises: introducing into the mesenchymal stem cell one or more deoxyribonucleic acid (DNA) endonucleases to effect one or more single-strand breaks (SSBs) or double-strand breaks (DSBs) within or near the SCN9A gene or SCN9A regulatory elements that results in one or more permanent insertions, deletions or mutations of at least one nucleotide within or near the SCN9A gene, thereby reducing or eliminating the expression or function of SCN9A gene products.

Also provided herein is an in vivo method for treating a patient with an SCN9A related disorder comprising: editing the Sodium Voltage-Gated Channel Alpha Subunit 9 (SCN9A) gene in a cell of the patient.

In some aspects, the editing step comprises: introducing into the cell one or more deoxyribonucleic acid (DNA) endonucleases to effect one or more single-strand breaks (SSBs) or double-strand breaks (DSBs) within or near the SCN9A gene or SCN9A regulatory elements that results in one or more permanent insertions, deletions or mutations of at least one nucleotide within or near the SCN9A gene, thereby reducing or eliminating the expression or function of SCN9A gene products.

In some aspects, the cell is a neuron of the peripheral nervous system. In some aspects, the one or more deoxyribonucleic acid (DNA) endonuclease is delivered to the neuron of the peripheral nervous system via direct intraganglionic or intraspinal injection, or intrathecal delivery.

Also provided herein is a method of altering the contiguous genomic sequence of an SCN9A gene in a cell comprising: contacting the cell with one or more deoxyribonucleic acid (DNA) endonuclease to effect one or more single-strand breaks (SSBs) or double-strand breaks (DSBs). In some aspects, the alteration of the contiguous genomic sequence occurs in one or more exons of the SCN9A gene.

In some aspects, the one or more deoxyribonucleic acid (DNA) endonuclease is selected from any of those in SEQ ID NOs: 1-620 and variants having at least 90% homology to any of the sequences listed in SEQ ID NOs: 1-620.

In some aspects, the one or more deoxyribonucleic acid (DNA) endonuclease is one or more protein or polypeptide. In some aspects, the one or more deoxyribonucleic acid (DNA) endonuclease is one or more polynucleotide encoding the one or more DNA endonuclease. In some aspects, the one or more deoxyribonucleic acid (DNA) endonuclease is one or more ribonucleic acid (RNA) encoding the one or more DNA endonuclease. In some aspects, the one or more ribonucleic acid (RNA) is one or more chemically modified RNA. In some aspects, the one or more ribonucleic acid (RNA) is chemically modified in the coding region. In some aspects, the one or more polynucleotide or one or more ribonucleic acid (RNA) is codon optimized.

In some aspects, the methods further comprise introducing into the cell one or more gRNA or one or more sgRNA. In some aspects, the one or more gRNA or one or more sgRNA comprises a spacer sequence that is complementary to a DNA sequence within or near the SCN9A gene. In some aspects, the one or more gRNA or one or more sgRNA is chemically modified. In some aspects, the one or more gRNA or one or more sgRNA is pre-complexed with the one or more deoxyribonucleic acid (DNA) endonuclease. In some aspects, the pre-complexing involves a covalent attachment of the one or more gRNA or one or more sgRNA to the one or more deoxyribonucleic acid (DNA) endonuclease.

In some aspects, the one or more deoxyribonucleic acid (DNA) endonuclease is formulated in a liposome or lipid nanoparticle. In some aspects, the one or more deoxyribonucleic acid (DNA) endonuclease is formulated in a liposome or lipid nanoparticle which also comprises the one or more gRNA or one or more sgRNA.

In some aspects, the one or more deoxyribonucleic acid (DNA) endonuclease is encoded in an AAV vector particle. In some aspects, the one or more gRNA or one or more sgRNA is encoded in an AAV vector particle. In some aspects, the one or more deoxyribonucleic acid (DNA) endonuclease is encoded in an AAV vector particle, which also encodes the one or more gRNA or one or more sgRNA. In some aspects, the AAV vector particle is selected from any of those disclosed in SEQ ID NOs: 4734-5302 and Table 2.

Also provided herein is a single-molecule guide RNA comprising: at least a spacer sequence that is an RNA sequence corresponding to any of SEQ ID NOs: 5305-125469. In some aspects, the single-molecule guide RNA further comprises a spacer extension region. In some aspects, the single-molecule guide RNA further comprises a tracrRNA extension region. In some aspects, the single-molecule guide RNA is chemically modified.

In some aspects, the single-molecule guide RNA is pre-complexed with a site-directed polypeptide. In some aspects, the site-directed polypeptide is a DNA endonuclease. In some aspects, the DNA endonuclease is a Cas9 or CPf1 endonuclease. In some aspects, the Cas9 or Cpf1 endonuclease is selected from a group consisting of: *S. pyogenes* Cas9, *S. aureus* Cas9, *N. meningitides* Cas9, *S. thermophilus* CRISPR1 Cas9, *S. thermophilus* CRISPR 3 Cas9, *T. denticola* Cas9, *L. bacterium* ND2006 Cpf1 and *Acidaminococcus* sp. BV3L6 Cpf1, and variants having at least 90% homology to these endonucleases. In some aspects, the Cas9 or Cpf1 endonuclease comprises one or more nuclear localization signals (NLSs). In some aspects, at least one NLS is at or within 50 amino acids of the amino-terminus of the Cas9 or Cpf1 endonuclease and/or at least one NLS is at or within 50 amino acids of the carboxy-terminus of the Cas9 or Cpf1 endonuclease.

Also provided herein is RNA encoding the single-molecule guide polynucleotide described herein.

Also provided herein is RNA encoding the CRISPR/Cas system described herein.

Also provided herein is a DNA encoding the single-molecule guide RNA described herein.

Also provided herein is a DNA encoding the CRISPR/Cas system described herein.

Also provided herein is a vector comprising a DNA encoding the single-molecule guide RNA or CRISPR/Cas system. In some aspects, the vector is a plasmid. In some aspects, the vector is an AAV vector particle, wherein the AAV vector serotype is selected from those listed in SEQ ID NOs: 4734-5302 or Table 2.

BRIEF DESCRIPTION OF THE DRAWINGS

Various aspects of materials and methods disclosed and described in this specification can be better understood by reference to the accompanying figures, in which:

FIG. 1A is a depiction of the type II CRISPR/Cas system including gRNA;

FIG. 1B is another depiction of the type II CRISPR/Cas system including sgRNA;

FIGS. 2A-G describe the cutting efficiencies of *S. pyogenes* gRNAs selected via an in-vitro transcribed (IVT) gRNA screen;

FIG. 2A describes the cutting efficiencies in the range of 93.3-98.5% of *S. pyogenes* gRNAs selected via an in-vitro transcribed (IVT) gRNA screen;

FIG. 2B describes the cutting efficiencies in the range of 86.1-93% of *S. pyogenes* gRNAs selected via an in-vitro transcribed (IVT) gRNA screen;

FIG. 2C describes the cutting efficiencies in the range of 78.8-86% of *S. pyogenes* gRNAs selected via an in-vitro transcribed (IVT) gRNA screen;

FIG. 2D describes the cutting efficiencies in the range of 67.2-78.8% of *S. pyogenes* gRNAs selected via an in-vitro transcribed (IVT) gRNA screen;

FIG. 2E describes the cutting efficiencies in the range of 50.7-66.8% of *S. pyogenes* gRNAs selected via an in-vitro transcribed (IVT) gRNA screen;

FIG. 2F describes the cutting efficiencies in the range of 23.4-49.8% of *S. pyogenes* gRNAs selected via an in-vitro transcribed (IVT) gRNA screen;

FIG. 2G describes the cutting efficiencies in the range of 4.1-22.1% of *S. pyogenes* gRNAs selected via an in-vitro transcribed (IVT) gRNA screen;

FIGS. 3A-C describe the cutting efficiency of *S. pyogenes* gRNAs in HEK293T cells targeting the SCN9A gene;

FIG. 3A describes the cutting efficiency in the range of 80.9-98.5% of *S. pyogenes* gRNAs in HEK293T cells targeting the SCN9A gene;

FIG. 3B describes the cutting efficiency in the range of 50.7-80.9% of *S. pyogenes* gRNAs in HEK293T cells targeting the SCN9A gene; and FIG. 3C describes the cutting efficiency in the range of 4.1-49.8% of *S. pyogenes* gRNAs in HEK293T cells targeting the SCN9A gene.

BRIEF DESCRIPTION OF SEQUENCE LISTING

Figure 1A:
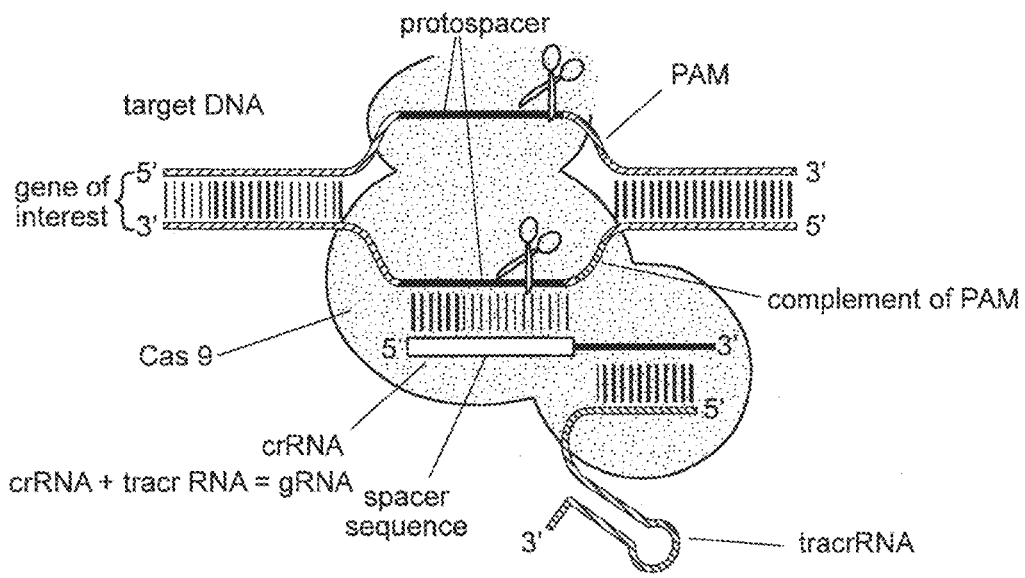
FIGS. 1A-B depict the type II CRISPR/Cas system.

SEQ ID NOs: 1-620 are Cas endonuclease ortholog sequences.
SEQ ID NOs: 621-631 do not include sequences.
SEQ ID NOs: 632-4715 are microRNA sequences.
SEQ ID NOs: 4716-4733 do not include sequences.
SEQ ID NOs: 4734-5302 are AAV serotype sequences.
SEQ ID NO: 5303 is a SCN9A nucleotide sequence.
SEQ ID NO: 5304 is a gene sequence including 1-5 kilobase pairs upstream and/or downstream of the SCN9A gene.
SEQ ID NOs: 5305-6250 are 20 bp spacer sequences for targeting within or near a SCN9A gene or other DNA sequence that encodes a regulatory element of the SCN9A gene with a *T. denticola* Cas9 endonuclease.
SEQ ID NOs: 6251-8561 are 20 bp spacer sequences for targeting within or near a SCN9A gene or other DNA sequence that encodes a regulatory element of the SCN9A gene with a *S. thermophilus* Cas9 endonuclease.
SEQ ID NOs: 8562-13614 are 20 bp spacer sequences for targeting within or near a SCN9A gene or other DNA sequence that encodes a regulatory element of the SCN9A gene with a *S. aureus* Cas9 endonuclease.
SEQ ID NOs: 13615-18988 are 20 bp spacer sequences for targeting within or near a SCN9A gene or other DNA sequence that encodes a regulatory element of the SCN9A gene with a *N. meningitides* Cas9 endonuclease.
SEQ ID NOs: 18989-56863 are 20 bp spacer sequences for targeting within or near a SCN9A gene or other DNA sequence that encodes a regulatory element of the SCN9A gene with a *S. pyogenes* Cas9 endonuclease.
SEQ ID NOs: 56864-125469 are 20 bp spacer sequences for targeting within or near a SCN9A gene or other DNA sequence that encodes a regulatory element of the SCN9A gene with an *Acidaminococcus*, a *Lachnospiraceae*, and a *Franciscella Novicida* Cpf1 endonuclease.
SEQ ID NOs: 125470-125499 do not include sequences.
SEQ ID NO: 125500 is a sample guide RNA (gRNA) for a *S. pyogenes* Cas9 endonuclease.
SEQ ID NOs: 125501-125503 show sample sgRNA sequences.

DETAILED DESCRIPTION

I. Introduction

Genome Editing

The present disclosure provides strategies and techniques for the targeted, specific alteration of the genetic information (genome) of living organisms. As used herein, the term "alteration" or "alteration of genetic information" refers to any change in the genome of a cell. In the context of treating genetic disorders, alterations may include, but are not limited to, insertion, deletion and correction. As used herein, the term "insertion" refers to an addition of one or more nucleotides in a DNA sequence. Insertions can range from small insertions of a few nucleotides to insertions of large segments such as a cDNA or a gene. The term "deletion" refers to a loss or removal of one or more nucleotides in a DNA sequence or a loss or removal of the function of a gene. In some cases, a deletion can include, for example, a loss of a few nucleotides, an exon, an intron, a gene segment, or the entire sequence of a gene. In some cases, deletion of a gene refers to the elimination or reduction of the function or expression of a gene or its gene product. This can result from not only a deletion of sequences within or near the gene, but also other events (e.g., insertion, nonsense mutation) that disrupt the expression of the gene. The term "correction" as used herein, refers to a change of one or more nucleotides of a genome in a cell, whether by insertion, deletion or substitution. Such correction may result in a more favorable genotypic or phenotypic outcome, whether in structure or function, to the genomic site which was corrected. One non-limiting example of a "correction" includes the correction of a mutant or defective sequence to a wild-type sequence which restores structure or function to a gene or its gene product(s). Depending on the nature of the mutation, correction may be achieved via various strategies disclosed herein. In one non-limiting example, a missense mutation may be corrected by replacing the region containing the mutation with its wild-type counterpart. As another example, duplication mutations (e.g., repeat expansions) in a gene may be corrected by removing the extra sequences.

In some aspects, alterations may also include a gene knock-in, knock-out or knock-down. As used herein, the term "knock-in" refers to an addition of a DNA sequence, or fragment thereof into a genome. Such DNA sequences to be knocked-in may include an entire gene or genes, may include regulatory sequences associated with a gene or any portion or fragment of the foregoing. For example, a cDNA encoding the wild-type protein may be inserted into the genome of a cell carrying a mutant gene. Knock-in strategies need not replace the defective gene, in whole or in part. In some cases, a knock-in strategy may further involve substitution of an existing sequence with the provided sequence, e.g., substitution of a mutant allele with a wild-type copy. On the other hand, the term "knock-out" refers to the elimination of a gene or the expression of a gene. For example, a gene can be knocked out by either a deletion or an addition of a nucleotide sequence that leads to a disruption of the reading frame. As another example, a gene may be knocked out by replacing a part of the gene with an irrelevant sequence. Finally, the term "knock-down" as used herein refers to reduction in the expression of a gene or its gene product(s). As a result of a gene knock-down, the protein activity or function may be attenuated or the protein levels may be reduced or eliminated.

Genome editing generally refers to the process of modifying the nucleotide sequence of a genome, preferably in a precise or pre-determined manner. Examples of methods of genome editing described herein include methods of using site-directed nucleases to cut deoxyribonucleic acid (DNA) at precise target locations in the genome, thereby creating single-strand or double-strand DNA breaks at particular locations within the genome. Such breaks can be and regularly are repaired by natural, endogenous cellular processes, such as homology-directed repair (HDR) and non-homologous end joining (NHEJ), as reviewed in Cox et al., Nature Medicine 21(2), 121-31 (2015). These two main DNA repair processes consist of a family of alternative pathways. NHEJ directly joins the DNA ends resulting from a double-strand break, sometimes with the loss or addition of nucleotide sequence, which may disrupt or enhance gene expression. HDR utilizes a homologous sequence, or donor sequence, as a template for inserting a defined DNA sequence at the break point. The homologous sequence can be in the endogenous genome, such as a sister chromatid. Alternatively, the donor can be an exogenous nucleic acid, such as a plasmid, a single-strand oligonucleotide, a double-stranded oligonucleotide, a duplex oligonucleotide or a virus, that has regions of high homology with the nuclease-cleaved locus, but which can also contain additional sequence or sequence changes including deletions that can be incorporated into the cleaved target locus. A third repair mechanism can be microhomology-mediated end joining (MMEJ), also referred to as "Alternative NHEJ," in which the genetic outcome is similar to NHEJ in that small deletions and insertions can occur at the cleavage site. MMEJ can make use of homologous sequences of a few base pairs flanking the DNA break site to drive a more favored DNA end joining repair outcome, and recent reports have further elucidated the molecular mechanism of this process; see, e.g., Cho and Greenberg, Nature 518, 174-76 (2015); Kent et al., Nature Structural and Molecular Biology, Adv. Online doi:10.1038/nsmb.2961 (2015); Mateos-Gomez et al., Nature 518, 254-57 (2015); Ceccaldi et al., Nature 528, 258-62 (2015). In some instances, it may be possible to predict likely repair outcomes based on analysis of potential microhomologies at the site of the DNA break.

Each of these genome editing mechanisms can be used to create desired genomic alterations. A step in the genome editing process can be to create one or two DNA breaks, the latter as double-strand breaks or as two single-stranded breaks, in the target locus as near the site of intended mutation. This can be achieved via the use of site-directed polypeptides, as described and illustrated herein.

CRISPR Endonuclease System

A CRISPR (Clustered Regularly Interspaced Short Palindromic Repeats) genomic locus can be found in the genomes of many prokaryotes (e.g., bacteria and archaea). In prokaryotes, the CRISPR locus encodes products that function as a type of immune system to help defend the prokaryotes against foreign invaders, such as virus and phage. There are three stages of CRISPR locus function: integration of new sequences into the CRISPR locus, expression of CRISPR RNA (crRNA), and silencing of foreign invader nucleic acid. Five types of CRISPR systems (e.g., Type I, Type II, Type III, Type U, and Type V) have been identified.

A CRISPR locus includes a number of short repeating sequences referred to as "repeats." When expressed, the repeats can form secondary structures (e.g., hairpins) and/or comprise unstructured single-stranded sequences. The repeats usually occur in clusters and frequently diverge between species. The repeats are regularly interspaced with unique intervening sequences referred to as "spacers," resulting in a repeat-spacer-repeat locus architecture. The spacers are identical to or have high homology with known foreign invader sequences. A spacer-repeat unit encodes a crisprRNA (crRNA), which is processed into a mature form of the spacer-repeat unit. A crRNA comprises a "seed" or spacer sequence that is involved in targeting a target nucleic acid (in the naturally occurring form in prokaryotes, the spacer sequence targets the foreign invader nucleic acid). A spacer sequence is located at the 5' or 3' end of the crRNA.

A CRISPR locus also comprises polynucleotide sequences encoding CRISPR Associated (Cas) genes. Cas genes encode endonucleases involved in the biogenesis and the interference stages of crRNA function in prokaryotes. Some Cas genes comprise homologous secondary and/or tertiary structures.

Figure 1B:
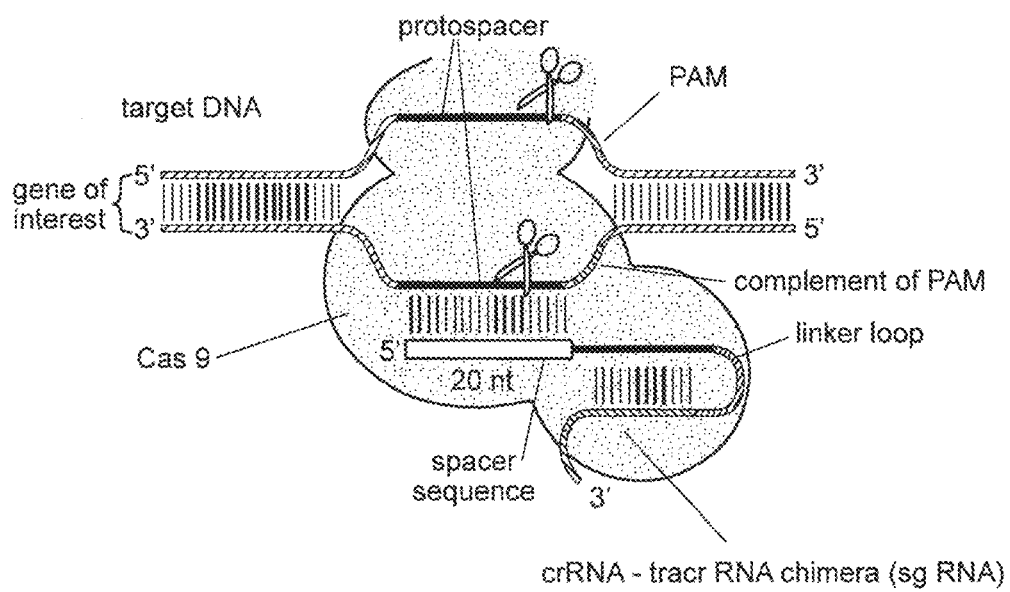

Type II CRISPR Systems crRNA biogenesis in a Type II CRISPR system in nature requires a trans-activating CRISPR RNA (tracrRNA). Non-limiting examples of Type II CRISPR systems are shown in FIGS. 1A and 1B. The tracrRNA can be modified by endogenous RNaseIII, and then hybridizes to a crRNA repeat in the pre-crRNA array. Endogenous RNaseIII can be recruited to cleave the pre-crRNA. Cleaved crRNAs can be subjected to exoribonuclease trimming to produce the mature crRNA form (e.g., 5' trimming). The tracrRNA can remain hybridized to the crRNA, and the tracrRNA and the crRNA associate with a site-directed polypeptide (e.g., Cas9). The crRNA of the crRNA-tracrRNA-Cas9 complex can guide the complex to a target nucleic acid to which the crRNA can hybridize. Hybridization of the crRNA to the target nucleic acid can activate Cas9 for targeted nucleic acid cleavage. The target nucleic acid in a Type II CRISPR system is referred to as a protospacer adjacent motif (PAM). In nature, the PAM is essential to facilitate binding of a site-directed polypeptide (e.g., Cas9) to the target nucleic acid. Type II systems (also referred to as Nmeni or CASS4) are further subdivided into Type II-A (CASS4) and II-B (CASS4a). Jinek et al., *Science,* 337(6096):816-821 (2012) showed that the CRISPR/Cas9 system is useful for RNA-programmable genome editing, and international patent application publication number WO2013/176772 provides numerous examples and applications of the CRISPR/Cas endonuclease system for site-specific gene editing.

Type V CRISPR Systems

Type V CRISPR systems have several important differences from Type II systems. For example, Cpf1 is a single RNA-guided endonuclease that, in contrast to Type II systems, lacks tracrRNA. In fact, Cpf1-associated CRISPR arrays can be processed into mature crRNAs without the requirement of an additional trans-activating tracrRNA. The Type V CRISPR array can be processed into short mature crRNAs of 42-44 nucleotides in length, with each mature crRNA beginning with 19 nucleotides of direct repeat followed by 23-25 nucleotides of spacer sequence. In contrast, mature crRNAs in Type II systems can start with 20-24 nucleotides of spacer sequence followed by about 22 nucleotides of direct repeat. Also, Cpf1 can utilize a T-rich protospacer-adjacent motif such that Cpf1-crRNA complexes efficiently cleave target DNA preceded by a short T-rich PAM, which is in contrast to the G-rich PAM following the target DNA for Type II systems. Thus, Type V systems cleave at a point that is distant from the PAM, while Type II systems cleave at a point that is adjacent to the PAM. In addition, in contrast to Type II systems, Cpf1 cleaves DNA via a staggered DNA double-stranded break with a 4 or 5 nucleotide 5' overhang. Type II systems cleave via a blunt double-stranded break. Similar to Type II systems, Cpf1 contains a predicted RuvC-like endonuclease domain, but lacks a second HNH endonuclease domain, which is in contrast to Type II systems.

Cas Genes/Polypeptides and Protospacer Adjacent Motifs

Exemplary CRISPR/Cas polypeptides include the Cas9 polypeptides as published in Fonfara et al., *Nucleic Acids Research,* 42: 2577-2590 (2014). The CRISPR/Cas gene naming system has undergone extensive rewriting since the Cas genes were discovered. Fonfara et al. also provides PAM sequences for the Cas9 polypeptides from various species (see also Table 1 infra).

II. Compositions and Methods of the Disclosure

Provided herein are cellular, ex vivo and in vivo methods for using genome engineering tools to create permanent changes to the genome by deleting or mutating the SCN9A gene or other DNA sequences that encode regulatory elements of the SCN9A gene. Such methods use endonucleases, such as CRISPR-associated (Cas9, Cpf1 and the like) nucleases, to permanently edit within or near the genomic locus of the SCN9A gene or other DNA sequences that encode regulatory elements of the SCN9A gene. In this way, examples set forth in the present disclosure can help to reduce or eliminate the expression of the SCN9A gene with as few as a single treatment (rather than deliver potential therapies for the lifetime of the patient).

Site-Directed Polypeptides (Endonucleases, Enzymes)

A site-directed polypeptide is a nuclease used in genome editing to cleave DNA. The site-directed polypeptide can be administered to a cell or a patient as either: one or more polypeptides, or one or more mRNAs encoding the polypeptide. Any of the enzymes or orthologs listed in SEQ ID NOs: 1-620, or disclosed herein, may be utilized in the methods herein. Single-molecule guide RNA can be pre-complexed with a site-directed polypeptide. The site-directed polypeptide can be any of the DNA endonuclease disclosed herein.

In the context of a CRISPR/Cas9 or CRISPR/Cpf1 system, the site-directed polypeptide can bind to a guide RNA that, in turn, specifies the site in the target DNA to which the polypeptide is directed. In the CRISPR/Cas9 or CRISPR/Cpf1 systems disclosed herein, the site-directed polypeptide can be an endonuclease, such as a DNA endonuclease.

A site-directed polypeptide can comprise a plurality of nucleic acid-cleaving (i.e., nuclease) domains. Two or more nucleic acid-cleaving domains can be linked together via a linker. For example, the linker can comprise a flexible linker. Linkers can comprise 1, 2, 3, 4, 5, 6, 7, 8, 9, 10, 11, 12, 13, 14, 15, 16, 17, 18, 19, 20, 21, 22, 23, 24, 25, 30, 35, 40 or more amino acids in length.

Naturally-occurring wild-type Cas9 enzymes comprise two nuclease domains, a HNH nuclease domain and a RuvC domain. Herein, the term "Cas9" refers to both a naturally-occurring and a recombinant Cas9. Cas9 enzymes contemplated herein can comprise a HNH or HNH-like nuclease domain, and/or a RuvC or RuvC-like nuclease domain.

HNH or HNH-like domains comprise a McrA-like fold. HNH or HNH-like domains comprises two antiparallel β-strands and an α-helix. HNH or HNH-like domains comprises a metal binding site (e.g., a divalent cation binding site). HNH or HNH-like domains can cleave one strand of a target nucleic acid (e.g., the complementary strand of the crRNA targeted strand).

RuvC or RuvC-like domains comprise an RNaseH or RNaseH-like fold. RuvC/RNaseH domains are involved in a diverse set of nucleic acid-based functions including acting on both RNA and DNA. The RNaseH domain comprises 5 β-strands surrounded by a plurality of α-helices. RuvC/RNaseH or RuvC/RNaseH-like domains comprise a metal binding site (e.g., a divalent cation binding site). RuvC/RNaseH or RuvC/RNaseH-like domains can cleave one strand of a target nucleic acid (e.g., the non-complementary strand of a double-stranded target DNA).

Site-directed polypeptides can introduce double-strand breaks or single-strand breaks in nucleic acids, e.g., genomic DNA. The double-strand break can stimulate a cell's endogenous DNA-repair pathways (e.g., homology-dependent repair (HDR) or NHEJ or alternative non-homologous end joining (A-NHEJ) or microhomology-mediated end joining (MMEJ)). NHEJ can repair cleaved target nucleic acid without the need for a homologous template. This can sometimes result in small deletions or insertions (indels) in the target nucleic acid at the site of cleavage, and can lead to disruption or alteration of gene expression. HDR can occur when a homologous repair template, or donor, is available. The homologous donor template can comprise sequences that are homologous to sequences flanking the target nucleic acid cleavage site. The sister chromatid can be used by the cell as the repair template. However, for the purposes of genome editing, the repair template can be supplied as an exogenous nucleic acid, such as a plasmid, duplex oligonucleotide, single-strand oligonucleotide or viral nucleic acid. With exogenous donor templates, an additional nucleic acid sequence (such as a transgene) or modification (such as a single or multiple base change or a deletion) can be introduced between the flanking regions of homology so that the additional or altered nucleic acid sequence also becomes incorporated into the target locus. MMEJ can result in a genetic outcome that is similar to NHEJ in that small deletions and insertions can occur at the cleavage site. MMEJ can make use of homologous sequences of a few base pairs flanking the cleavage site to drive a favored end-joining DNA repair outcome. In some instances, it may be possible to predict likely repair outcomes based on analysis of potential microhomologies in the nuclease target regions.

Thus, in some cases, homologous recombination can be used to insert an exogenous polynucleotide sequence into the target nucleic acid cleavage site. An exogenous polynucleotide sequence is termed a "donor polynucleotide" (or donor or donor sequence) herein. The donor polynucleotide, a portion of the donor polynucleotide, a copy of the donor polynucleotide, or a portion of a copy of the donor polynucleotide can be inserted into the target nucleic acid cleavage site. The donor polynucleotide can be an exogenous polynucleotide sequence, i.e., a sequence that does not naturally occur at the target nucleic acid cleavage site.

The modifications of the target DNA due to NHEJ and/or HDR can lead to, for example, mutations, deletions, alterations, integrations, gene correction, gene replacement, gene tagging, transgene insertion, nucleotide deletion, gene disruption, translocations and/or gene mutation. The processes of deleting genomic DNA and integrating non-native nucleic acid into genomic DNA are examples of genome editing.

The site-directed polypeptide can comprise an amino acid sequence having at least 10%, at least 15%, at least 20%, at least 30%, at least 40%, at least 50%, at least 60%, at least 70%, at least 75%, at least 80%, at least 85%, at least 90%, at least 95%, at least 99%, or 100% amino acid sequence identity to a wild-type exemplary site-directed polypeptide [e.g., Cas9 from *S. pyogenes*, US2014/0068797 Sequence ID No. 8 or Sapranauskas et al., *Nucleic Acids Res*, 39(21): 9275-9282 (2011)], and various other site-directed polypeptides. The site-directed polypeptide can comprise at least 70, 75, 80, 85, 90, 95, 97, 99, or 100% identity to a wild-type site-directed polypeptide (e.g., Cas9 from *S. pyogenes*, supra) over 10 contiguous amino acids. The site-directed polypeptide can comprise at most: 70, 75, 80, 85, 90, 95, 97, 99, or 100% identity to a wild-type site-directed polypeptide (e.g., Cas9 from *S. pyogenes*, supra) over 10 contiguous amino acids. The site-directed polypeptide can comprise at least: 70, 75, 80, 85, 90, 95, 97, 99, or 100% identity to a wild-type site-directed polypeptide (e.g., Cas9 from *S. pyogenes*, supra) over 10 contiguous amino acids in a HNH nuclease domain of the site-directed polypeptide. The site-directed polypeptide can comprise at most: 70, 75, 80, 85, 90, 95, 97, 99, or 100% identity to a wild-type site-directed polypeptide (e.g., Cas9 from *S. pyogenes*, supra) over 10 contiguous amino acids in a HNH nuclease domain of the site-directed polypeptide. The site-directed polypeptide can comprise at least: 70, 75, 80, 85, 90, 95, 97, 99, or 100% identity to a wild-type site-directed polypeptide (e.g., Cas9 from *S. pyogenes*, supra) over 10 contiguous amino acids in a RuvC nuclease domain of the site-directed polypeptide. The site-directed polypeptide can comprise at most: 70, 75, 80, 85, 90, 95, 97, 99, or 100% identity to a wild-type site-directed polypeptide (e.g., Cas9 from *S. pyogenes*, supra) over 10 contiguous amino acids in a RuvC nuclease domain of the site-directed polypeptide.

The site-directed polypeptide can comprise a modified form of a wild-type exemplary site-directed polypeptide. The modified form of the wild-type exemplary site-directed polypeptide can comprise a mutation that reduces the nucleic acid-cleaving activity of the site-directed polypeptide. The modified form of the wild-type exemplary site-directed polypeptide can have less than 90%, less than 80%, less than 70%, less than 60%, less than 50%, less than 40%, less than 30%, less than 20%, less than 10%, less than 5%, or less than 1% of the nucleic acid-cleaving activity of the wild-type exemplary site-directed polypeptide (e.g., Cas9 from *S. pyogenes*, supra). The modified form of the site-directed polypeptide can have no substantial nucleic acid-cleaving activity. When a site-directed polypeptide is a modified form that has no substantial nucleic acid-cleaving activity, it is referred to herein as "enzymatically inactive."

The modified form of the site-directed polypeptide can comprise a mutation such that it can induce a single-strand break (SSB) on a target nucleic acid (e.g., by cutting only one of the sugar-phosphate backbones of a double-strand target nucleic acid). In some aspects, the mutation can result in less than 90%, less than 80%, less than 70%, less than 60%, less than 50%, less than 40%, less than 30%, less than 20%, less than 10%, less than 5%, or less than 1% of the nucleic acid-cleaving activity in one or more of the plurality of nucleic acid-cleaving domains of the wild-type site directed polypeptide (e.g., Cas9 from *S. pyogenes*, supra). In some aspects, the mutation can result in one or more of the plurality of nucleic acid-cleaving domains retaining the ability to cleave the complementary strand of the target nucleic acid, but reducing its ability to cleave the non-complementary strand of the target nucleic acid. The mutation can result in one or more of the plurality of nucleic acid-cleaving domains retaining the ability to cleave the non-complementary strand of the target nucleic acid, but reducing its ability to cleave the complementary strand of the target nucleic acid. For example, residues in the wild-type exemplary *S. pyogenes* Cas9 polypeptide, such as Asp10, His840, Asn854 and Asn856, are mutated to inactivate one or more of the plurality of nucleic acid-cleaving domains (e.g., nuclease domains). The residues to be mutated can correspond to residues Asp10, His840, Asn854 and Asn856 in the wild-type exemplary *S. pyogenes* Cas9 polypeptide (e.g., as determined by sequence and/or structural alignment). Non-limiting examples of mutations include D10A, H840A, N854A or N856A. One skilled in the art will recognize that mutations other than alanine substitutions can be suitable.

In some aspects, a D10A mutation can be combined with one or more of H840A, N854A, or N856A mutations to produce a site-directed polypeptide substantially lacking DNA cleavage activity. A H840A mutation can be combined with one or more of D10A, N854A, or N856A mutations to produce a site-directed polypeptide substantially lacking DNA cleavage activity. A N854A mutation can be combined with one or more of H840A, D10A, or N856A mutations to produce a site-directed polypeptide substantially lacking DNA cleavage activity. A N856A mutation can be combined with one or more of H840A, N854A, or D10A mutations to produce a site-directed polypeptide substantially lacking DNA cleavage activity. Site-directed polypeptides that comprise one substantially inactive nuclease domain are referred to as "nickases."

Nickase variants of RNA-guided endonucleases, for example Cas9, can be used to increase the specificity of CRISPR-mediated genome editing. Wild type Cas9 is typically guided by a single guide RNA designed to hybridize with a specified ~20 nucleotide sequence in the target sequence (such as an endogenous genomic locus). However, several mismatches can be tolerated between the guide RNA and the target locus, effectively reducing the length of required homology in the target site to, for example, as little as 13 nt of homology, and thereby resulting in elevated potential for binding and double-strand nucleic acid cleavage by the CRISPR/Cas9 complex elsewhere in the target genome—also known as off-target cleavage. Because nickase variants of Cas9 each only cut one strand, in order to create a double-strand break it is necessary for a pair of nickases to bind in close proximity and on opposite strands of the target nucleic acid, thereby creating a pair of nicks, which is the equivalent of a double-strand break. This requires that two separate guide RNAs—one for each nickase—must bind in close proximity and on opposite strands of the target nucleic acid. This requirement essentially doubles the minimum length of homology needed for the double-strand break to occur, thereby reducing the likelihood that a double-strand cleavage event will occur elsewhere in the genome, where the two guide RNA sites—if they exist—are unlikely to be sufficiently close to each other to enable the double-strand break to form. As described in the art, nickases can also be used to promote HDR versus NHEJ. HDR can be used to introduce selected changes into target sites in the genome through the use of specific donor sequences that effectively mediate the desired changes.

Mutations contemplated can include substitutions, additions, and deletions, or any combination thereof. The mutation converts the mutated amino acid to alanine. The mutation converts the mutated amino acid to another amino acid (e.g., glycine, serine, threonine, cysteine, valine, leucine, isoleucine, methionine, proline, phenylalanine, tyrosine, tryptophan, aspartic acid, glutamic acid, asparagine, glutamine, histidine, lysine, or arginine). The mutation converts the mutated amino acid to a non-natural amino acid (e.g., selenomethionine). The mutation converts the mutated amino acid to amino acid mimics (e.g., phosphomimics). The mutation can be a conservative mutation. For example, the mutation converts the mutated amino acid to amino acids that resemble the size, shape, charge, polarity, conformation, and/or rotamers of the mutated amino acids (e.g., cysteine/serine mutation, lysine/asparagine mutation, histidine/phenylalanine mutation). The mutation can cause a shift in reading frame and/or the creation of a premature stop codon. Mutations can cause changes to regulatory regions of genes or loci that affect expression of one or more genes.

The site-directed polypeptide (e.g., variant, mutated, enzymatically inactive and/or conditionally enzymatically inactive site-directed polypeptide) can target nucleic acid.

The site-directed polypeptide (e.g., variant, mutated, enzymatically inactive and/or conditionally enzymatically inactive endoribonuclease) can target DNA. The site-directed polypeptide (e.g., variant, mutated, enzymatically inactive and/or conditionally enzymatically inactive endoribonuclease) can target RNA.

The site-directed polypeptide can comprise one or more non-native sequences (e.g., the site-directed polypeptide is a fusion protein).

The site-directed polypeptide can comprise an amino acid sequence comprising at least 15% amino acid identity to a Cas9 from a bacterium (e.g., *S. pyogenes*), a nucleic acid binding domain, and two nucleic acid cleaving domains (i.e., a HNH domain and a RuvC domain).

The site-directed polypeptide can comprise an amino acid sequence comprising at least 15% amino acid identity to a Cas9 from a bacterium (e.g., *S. pyogenes*), and two nucleic acid cleaving domains (i.e., a HNH domain and a RuvC domain).

The site-directed polypeptide can comprise an amino acid sequence comprising at least 15% amino acid identity to a Cas9 from a bacterium (e.g., *S. pyogenes*), and two nucleic acid cleaving domains, wherein one or both of the nucleic acid cleaving domains comprise at least 50% amino acid identity to a nuclease domain from Cas9 from a bacterium (e.g., *S. pyogenes*).

The site-directed polypeptide can comprise an amino acid sequence comprising at least 15% amino acid identity to a Cas9 from a bacterium (e.g., *S. pyogenes*), two nucleic acid cleaving domains (i.e., a HNH domain and a RuvC domain), and a non-native sequence (for example, a nuclear localization signal) or a linker linking the site-directed polypeptide to a non-native sequence.

The site-directed polypeptide can comprise an amino acid sequence comprising at least 15% amino acid identity to a Cas9 from a bacterium (e.g., *S. pyogenes*), two nucleic acid cleaving domains (i.e., a HNH domain and a RuvC domain), wherein the site-directed polypeptide comprises a mutation in one or both of the nucleic acid cleaving domains that reduces the cleaving activity of the nuclease domains by at least 50%.

The site-directed polypeptide can comprise an amino acid sequence comprising at least 15% amino acid identity to a Cas9 from a bacterium (e.g., *S. pyogenes*), and two nucleic acid cleaving domains (i.e., a HNH domain and a RuvC domain), wherein one of the nuclease domains comprises mutation of aspartic acid 10, and/or wherein one of the nuclease domains can comprise a mutation of histidine 840, and wherein the mutation reduces the cleaving activity of the nuclease domain(s) by at least 50%.

The one or more site-directed polypeptides, e.g. DNA endonucleases, can comprise two nickases that together effect one double-strand break at a specific locus in the genome, or four nickases that together effect or cause two double-strand breaks at specific loci in the genome. Alternatively, one site-directed polypeptide, e.g. DNA endonuclease, can effect or cause one double-strand break at a specific locus in the genome.

Non-limiting examples of Cas9 orthologs from other bacterial strains include but are not limited to, Cas proteins identified in *Acaryochloris marina* MBIC11017; *Acetohalobium arabaticum* DSM 5501; *Acidithiobacillus caldus*; *Acidithiobacillus ferrooxidans* ATCC 23270; *Alicyclobacillus acidocaldarius* LAA1; *Alicyclobacillus acidocaldarius* subsp. *acidocaldarius* DSM 446; *Allochromatium vinosum* DSM 180; *Ammonifex degensii* KC4; *Anabaena variabilis* ATCC 29413; *Arthrospira maxima* CS-328; *Arthrospira platensis* str. *Paraca*; *Arthrospira* sp. PCC 8005; *Bacillus pseudomycoides* DSM 12442; *Bacillus selenitireducens* MLS10; *Burkholderiales bacterium* 1_1_47; *Caldicelulosiruptor becscii* DSM 6725; *Candidatus Desulforudis audaxviator* MP104C; *Caldicellulosiruptor hydrothermalis*_108; *Clostridium phage* c-st; *Clostridium botulinum* A3 str. Loch Maree; *Clostridium botulinum* Ba4 str. 657; *Clostridium difficile* QCD-63q42; *Crocosphaera watsonii* WH 8501; *Cyanothece* sp. ATCC 51142; *Cyanothece* sp. CCY0110; *Cyanothece* sp. PCC 7424; *Cyanothece* sp. PCC 7822; *Exiguobacterium sibiricum* 255-15; *Finegoldia magna* ATCC 29328; *Ktedonobacter racemifer* DSM 44963; *Lactobacillus delbrueckii* subsp. *bulgaricus* PB2003/044-T3-4; *Lactobacillus salivarius* ATCC 11741; *Listeria innocua*; *Lyngbya* sp. PCC 8106; *Marinobacter* sp. ELB17; *Methanohalobium evestigatum* Z-7303; *Microcystis phage* Ma-LMM01; *Microcystis aeruginosa* NIES-843; *Microscilla marina* ATCC 23134; *Microcoleus chthonoplastes* PCC 7420; *Neisseria meningitidis*; *Nitrosococcus halophilus* Nc4; *Nocardiopsis dassonvillei* subsp. *dassonvillei* DSM 43111; *Nodularia spumigena* CCY9414; *Nostoc* sp. PCC 7120; *Oscillatoria* sp. PCC 6506; *Pelotomaculum_thermopropionicum*_SI; *Petrotoga mobilis* SJ95; *Polaromonas naphthalenivorans* CJ2; *Polaromonas* sp. JS666; *Pseudoalteromonas haloplanktis* TAC125; *Streptomyces pristinaespiralis* ATCC 25486; *Streptomyces pristinaespiralis* ATCC 25486; *Streptococcus thermophilus*; *Streptomyces viridochromogenes* DSM 40736; *Streptosporangium roseum* DSM 43021; *Synechococcus* sp. PCC 7335; and *Thermosipho africanus* TCF52B (Chylinski et al., *RNA Biol.*, 2013; 10(5): 726-737).

In addition to Cas9 orthologs, other Cas9 variants such as fusion proteins of inactive dCas9 and effector domains with different functions may be served as a platform for genetic modulation. Any of the foregoing enzymes may be useful in the present disclosure.

Further examples of endonucleases that may be utilized in the present disclosure are given in SEQ ID NOs: 1-620. These proteins may be modified before use or may be encoded in a nucleic acid sequence such as a DNA, RNA or mRNA or within a vector construct such as the plasmids or AAV vectors taught herein. Further, they may be codon optimized.

SEQ ID NOs: 1-620 disclose a non-exhaustive listing of endonuclease sequences.

Genome-Targeting Nucleic Acid

The present disclosure provides a genome-targeting nucleic acid that can direct the activities of an associated polypeptide (e.g., a site-directed polypeptide) to a specific target sequence within a target nucleic acid. The genome-targeting nucleic acid can be an RNA. A genome-targeting RNA is referred to as a "guide RNA" or "gRNA" herein. A guide RNA can comprise at least a spacer sequence that hybridizes to a target nucleic acid sequence of interest, and a CRISPR repeat sequence. In Type II systems, the gRNA also comprises a second RNA called the tracrRNA sequence. In the Type II guide RNA (gRNA), the CRISPR repeat sequence and tracrRNA sequence hybridize to each other to form a duplex. In the Type V guide RNA (gRNA), the crRNA forms a duplex. In both systems, the duplex can bind a site-directed polypeptide, such that the guide RNA and site-direct polypeptide form a complex. The genome-targeting nucleic acid can provide target specificity to the complex by virtue of its association with the site-directed polypeptide. The genome-targeting nucleic acid thus can direct the activity of the site-directed polypeptide.

Exemplary guide RNAs include the spacer sequences in SEQ ID NOs: 5305-125469 of the Sequence Listing. As is understood by the person of ordinary skill in the art, each guide RNA can be designed to include a spacer sequence complementary to its genomic target sequence. For example, each of the spacer sequences in SEQ ID NOs: 5305-125469 of the Sequence Listing can be put into a single RNA chimera or a crRNA (along with a corresponding tracrRNA). See Jinek et al., Science, 337, 816-821 (2012) and Deltcheva et al., Nature, 471, 602-607 (2011).

The genome-targeting nucleic acid can be a double-molecule guide RNA. The genome-targeting nucleic acid can be a single-molecule guide RNA.

A double-molecule guide RNA can comprise two strands of RNA. The first strand comprises in the 5' to 3' direction, an optional spacer extension sequence, a spacer sequence and a minimum CRISPR repeat sequence. The second strand can comprise a minimum tracrRNA sequence (complementary to the minimum CRISPR repeat sequence), a 3' tracrRNA sequence and an optional tracrRNA extension sequence.

A single-molecule guide RNA (sgRNA) in a Type II system can comprise, in the 5' to 3' direction, an optional spacer extension sequence, a spacer sequence, a minimum CRISPR repeat sequence, a single-molecule guide linker, a minimum tracrRNA sequence, a 3' tracrRNA sequence and an optional tracrRNA extension sequence. The optional tracrRNA extension can comprise elements that contribute additional functionality (e.g., stability) to the guide RNA. The single-molecule guide linker can link the minimum CRISPR repeat and the minimum tracrRNA sequence to form a hairpin structure. The optional tracrRNA extension can comprise one or more hairpins.

The sgRNA can comprise a 20 nucleotide spacer sequence at the 5' end of the sgRNA sequence. The sgRNA can comprise a less than a 20 nucleotide spacer sequence at the 5' end of the sgRNA sequence. The sgRNA can comprise a more than 20 nucleotide spacer sequence at the 5' end of the sgRNA sequence. The sgRNA can comprise a variable length spacer sequence with 17-30 nucleotides at the 5' end of the sgRNA sequence (see Table 1).

The sgRNA can comprise no uracil at the 3' end of the sgRNA sequence, such as in SEQ ID NO: 125502 of Table 1. The sgRNA can comprise one or more uracil at the 3' end of the sgRNA sequence, such as in SEQ ID NO: 125503 in Table 1. For example, the sgRNA can comprise 1 uracil (U) at the 3' end of the sgRNA sequence. The sgRNA can comprise 2 uracil (UU) at the 3' end of the sgRNA sequence. The sgRNA can comprise 3 uracil (UUU) at the 3' end of the sgRNA sequence. The sgRNA can comprise 4 uracil (UUUU) at the 3' end of the sgRNA sequence. The sgRNA can comprise 5 uracil (UUUUU) at the 3' end of the sgRNA sequence. The sgRNA can comprise 6 uracil (UUUUUU) at the 3' end of the sgRNA sequence. The sgRNA can comprise 7 uracil (UUUUUUU) at the 3' end of the sgRNA sequence. The sgRNA can comprise 8 uracil (UUUUUUUU) at the 3' end of the sgRNA sequence.

The sgRNA can be unmodified or modified. For example, modified sgRNAs can comprise one or more 2'-O-methyl phosphorothioate nucleotides.

TABLE 1

| SEQ ID NO. | sgRNA sequence |
|---|---|
| 125501 | nnnnnnnnnnnnnnnnnnnnguuuuagagcuagaaauag caaguuaaaauaaggcuaguccguuaucaacuugaaaaa guggcaccgagucggugcuuuu |

TABLE 1-continued

| SEQ ID NO. | sgRNA sequence |
|---|---|
| 125502 | nnnnnnnnnnnnnnnnnnnnguuuuagagcuagaaauag caaguuaaaauaaggcuaguccguuaucaacuugaaaaa guggcaccgagucggugc |
| 125503 | $n_{(17-30)}$guuuuagagcuagaaauagcaaguuaaaauaag gcuaguccguuaucaacuugaaaaaguggcaccgaguc ggugcu$_{(1-8)}$ |

A single-molecule guide RNA (sgRNA) in a Type V system can comprise, in the 5' to 3' direction, a minimum CRISPR repeat sequence and a spacer sequence.

By way of illustration, guide RNAs used in the CRISPR/Cas9 or CRISPR/Cpf1 system, or other smaller RNAs can be readily synthesized by chemical means, as illustrated below and described in the art. While chemical synthetic procedures are continually expanding, purifications of such RNAs by procedures such as high performance liquid chromatography (HPLC, which avoids the use of gels such as PAGE) tends to become more challenging as polynucleotide lengths increase significantly beyond a hundred or so nucleotides. One approach used for generating RNAs of greater length is to produce two or more molecules that are ligated together. Much longer RNAs, such as those encoding a Cas9 or Cpf1 endonuclease, are more readily generated enzymatically. Various types of RNA modifications can be introduced during or after chemical synthesis and/or enzymatic generation of RNAs, e.g., modifications that enhance stability, reduce the likelihood or degree of innate immune response, and/or enhance other attributes, as described in the art.

Spacer Extension Sequence

In some examples of genome-targeting nucleic acids, a spacer extension sequence can modify activity, provide stability and/or provide a location for modifications of a genome-targeting nucleic acid. A spacer extension sequence can modify on- or off-target activity or specificity. In some examples, a spacer extension sequence can be provided. The spacer extension sequence can have a length of more than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, or 7000 or more nucleotides. The spacer extension sequence can have a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, 7000 or more nucleotides. The spacer extension sequence can be less than 10 nucleotides in length. The spacer extension sequence can be between 10-30 nucleotides in length. The spacer extension sequence can be between 30-70 nucleotides in length.

The spacer extension sequence can comprise another moiety (e.g., a stability control sequence, an endoribonuclease binding sequence, a ribozyme). The moiety can decrease or increase the stability of a nucleic acid targeting nucleic acid. The moiety can be a transcriptional terminator segment (i.e., a transcription termination sequence). The moiety can function in a eukaryotic cell. The moiety can function in a prokaryotic cell. The moiety can function in both eukaryotic and prokaryotic cells. Non-limiting examples of suitable moieties include: a 5' cap (e.g., a 7-methylguanylate cap (m7 G)), a riboswitch sequence (e.g., to allow for regulated stability and/or regulated accessibility by proteins and protein complexes), a sequence that forms a dsRNA duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like).

Spacer Sequence

The spacer sequence hybridizes to a sequence in a target nucleic acid of interest. The spacer of a genome-targeting nucleic acid can interact with a target nucleic acid in a sequence-specific manner via hybridization (i.e., base pairing). The nucleotide sequence of the spacer can vary depending on the sequence of the target nucleic acid of interest.

In a CRISPR/Cas system herein, the spacer sequence can be designed to hybridize to a target nucleic acid that is located 5' of a PAM of the Cas9 enzyme used in the system. The spacer may perfectly match the target sequence or may have mismatches. Each Cas9 enzyme has a particular PAM sequence that it recognizes in a target DNA. For example, *S. pyogenes* recognizes in a target nucleic acid a PAM that comprises the sequence 5'-NRG-3', where R comprises either A or G, where N is any nucleotide and N is immediately 3' of the target nucleic acid sequence targeted by the spacer sequence.

The target nucleic acid sequence can comprise 20 nucleotides. The target nucleic acid can comprise less than 20 nucleotides. The target nucleic acid can comprise more than 20 nucleotides. The target nucleic acid can comprise at least: 5, 10, 15, 16, 17, 18, 19, 20, 21, 22, 23, 24, 25, 30 or more nucleotides. The target nucleic acid can comprise at most: 5, 10, 15, 16, 17, 18, 19, 20, 21, 22, 23, 24, 25, 30 or more nucleotides. The target nucleic acid sequence can comprise 20 bases immediately 5' of the first nucleotide of the PAM. For example, in a sequence comprising 5'-NNNNNNNNNNNNNNNNNNNNNRG-3' (SEQ ID NO: 125500), the target nucleic acid can comprise the sequence that corresponds to the Ns, wherein N is any nucleotide, and the underlined NRG sequence is the *S. pyogenes* PAM. This target nucleic acid sequence is often referred to as the PAM strand, and the complementary nucleic acid sequence is often referred to the non-PAM strand. One of skill in the art would recognize that the spacer sequence hybridizes to the non-PAM strand of the target nucleic acid (FIGS. 1A and 1B).

The spacer sequence that hybridizes to the target nucleic acid can have a length of at least about 6 nucleotides (nt). The spacer sequence can be at least about 6 nt, at least about 10 nt, at least about 15 nt, at least about 18 nt, at least about 19 nt, at least about 20 nt, at least about 25 nt, at least about 30 nt, at least about 35 nt or at least about 40 nt, from about 6 nt to about 80 nt, from about 6 nt to about 50 nt, from about 6 nt to about 45 nt, from about 6 nt to about 40 nt, from about 6 nt to about 35 nt, from about 6 nt to about 30 nt, from about 6 nt to about 25 nt, from about 6 nt to about 20 nt, from about 6 nt to about 19 nt, from about 10 nt to about 50 nt, from about 10 nt to about 45 nt, from about 10 nt to about 40 nt, from about 10 nt to about 35 nt, from about 10 nt to about 30 nt, from about 10 nt to about 25 nt, from about 10 nt to about 20 nt, from about 10 nt to about 19 nt, from about 19 nt to about 25 nt, from about 19 nt to about 30 nt, from about 19 nt to about 35 nt, from about 19 nt to about 40 nt, from about 19 nt to about 45 nt, from about 19 nt to about 50 nt, from about 19 nt to about 60 nt, from about 20 nt to about 25 nt, from about 20 nt to about 30 nt, from about 20 nt to about 35 nt, from about 20 nt to about 40 nt, from about 20 nt to about 45 nt, from about 20 nt to about 50 nt, or from about 20 nt to about 60 nt. In some examples, the spacer sequence can comprise 20 nucleotides. In some examples, the spacer can comprise 19 nucleotides. In some examples, the spacer can comprise 18 nucleotides. In some examples, the spacer can comprise 22 nucleotides.

In some examples, the percent complementarity between the spacer sequence and the target nucleic acid is at least about 30%, at least about 40%, at least about 50%, at least about 60%, at least about 65%, at least about 70%, at least about 75%, at least about 80%, at least about 85%, at least about 90%, at least about 95%, at least about 97%, at least about 98%, at least about 99%, or 100%. In some examples, the percent complementarity between the spacer sequence and the target nucleic acid is at most about 30%, at most about 40%, at most about 50%, at most about 60%, at most about 65%, at most about 70%, at most about 75%, at most about 80%, at most about 85%, at most about 90%, at most about 95%, at most about 97%, at most about 98%, at most about 99%, or 100%. In some examples, the percent complementarity between the spacer sequence and the target nucleic acid is 100% over the six contiguous 5'-most nucleotides of the target sequence of the complementary strand of the target nucleic acid. The percent complementarity between the spacer sequence and the target nucleic acid can be at least 60% over about 20 contiguous nucleotides. The length of the spacer sequence and the target nucleic acid can differ by 1 to 6 nucleotides, which may be thought of as a bulge or bulges.

The spacer sequence can be designed or chosen using a computer program. The computer program can use variables, such as predicted melting temperature, secondary structure formation, predicted annealing temperature, sequence identity, genomic context, chromatin accessibility, % GC, frequency of genomic occurrence (e.g., of sequences that are identical or are similar but vary in one or more spots as a result of mismatch, insertion or deletion), methylation status, presence of SNPs, and the like.

Minimum CRISPR Repeat Sequence

In some aspects, a minimum CRISPR repeat sequence is a sequence with at least about 30%, about 40%, about 50%, about 60%, about 65%, about 70%, about 75%, about 80%, about 85%, about 90%, about 95%, or 100% sequence identity to a reference CRISPR repeat sequence (e.g., crRNA from *S. pyogenes*).

In some aspects, a minimum CRISPR repeat sequence comprises nucleotides that can hybridize to a minimum tracrRNA sequence in a cell. The minimum CRISPR repeat sequence and a minimum tracrRNA sequence can form a duplex, i.e. a base-paired double-stranded structure. Together, the minimum CRISPR repeat sequence and the minimum tracrRNA sequence can bind to the site-directed polypeptide. At least a part of the minimum CRISPR repeat sequence can hybridize to the minimum tracrRNA sequence. At least a part of the minimum CRISPR repeat sequence can comprise at least about 30%, about 40%, about 50%, about 60%, about 65%, about 70%, about 75%, about 80%, about 85%, about 90%, about 95%, or 100% complementary to the minimum tracrRNA sequence. In some aspects, at least a part of the minimum CRISPR repeat sequence comprises at most about 30%, about 40%, about 50%, about 60%, about 65%, about 70%, about 75%, about 80%, about 85%, about 90%, about 95%, or 100% complementary to the minimum tracrRNA sequence.

The minimum CRISPR repeat sequence can have a length from about 7 nucleotides to about 100 nucleotides. For example, the length of the minimum CRISPR repeat sequence is from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt, or from about 15 nt to about 25 nt. In some aspects, the minimum CRISPR repeat sequence is approximately 9 nucleotides in length. In some aspects, the minimum CRISPR repeat sequence is approximately 12 nucleotides in length.

The minimum CRISPR repeat sequence can be at least about 60% identical to a reference minimum CRISPR repeat sequence (e.g., wild-type crRNA from *S. pyogenes*) over a stretch of at least 6, 7, or 8 contiguous nucleotides. For example, the minimum CRISPR repeat sequence can be at least about 65% identical, at least about 70% identical, at least about 75% identical, at least about 80% identical, at least about 85% identical, at least about 90% identical, at least about 95% identical, at least about 98% identical, at least about 99% identical or 100% identical to a reference minimum CRISPR repeat sequence over a stretch of at least 6, 7, or 8 contiguous nucleotides.

Minimum tracrRNA Sequence

A minimum tracrRNA sequence can be a sequence with at least about 30%, about 40%, about 50%, about 60%, about 65%, about 70%, about 75%, about 80%, about 85%, about 90%, about 95%, or 100% sequence identity to a reference tracrRNA sequence (e.g., wild type tracrRNA from *S. pyogenes*).

A minimum tracrRNA sequence can comprise nucleotides that hybridize to a minimum CRISPR repeat sequence in a cell. A minimum tracrRNA sequence and a minimum CRISPR repeat sequence form a duplex, i.e. a base-paired double-stranded structure. Together, the minimum tracrRNA sequence and the minimum CRISPR repeat can bind to a site-directed polypeptide. At least a part of the minimum tracrRNA sequence can hybridize to the minimum CRISPR repeat sequence. The minimum tracrRNA sequence can be at least about 30%, about 40%, about 50%, about 60%, about 65%, about 70%, about 75%, about 80%, about 85%, about 90%, about 95%, or 100% complementary to the minimum CRISPR repeat sequence.

The minimum tracrRNA sequence can have a length from about 7 nucleotides to about 100 nucleotides. For example, the minimum tracrRNA sequence can be from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt or from about 15 nt to about 25 nt long. The minimum tracrRNA sequence can be approximately 9 nucleotides in length. The minimum tracrRNA sequence can be approximately 12 nucleotides. The minimum tracrRNA can consist of tracrRNA nt 23-48 described in Jinek et al., supra.

The minimum tracrRNA sequence can be at least about 60% identical to a reference minimum tracrRNA (e.g., wild type, tracrRNA from *S. pyogenes*) sequence over a stretch of at least 6, 7, or 8 contiguous nucleotides. For example, the minimum tracrRNA sequence can be at least about 65% identical, about 70% identical, about 75% identical, about 80% identical, about 85% identical, about 90% identical, about 95% identical, about 98% identical, about 99% identical or 100% identical to a reference minimum tracrRNA sequence over a stretch of at least 6, 7, or 8 contiguous nucleotides.

The duplex between the minimum CRISPR RNA and the minimum tracrRNA can comprise a double helix. The duplex between the minimum CRISPR RNA and the minimum tracrRNA can comprise at least about 1, 2, 3, 4, 5, 6, 7, 8, 9, or 10 or more nucleotides. The duplex between the minimum CRISPR RNA and the minimum tracrRNA can comprise at most about 1, 2, 3, 4, 5, 6, 7, 8, 9, or 10 or more nucleotides.

The duplex can comprise a mismatch (i.e., the two strands of the duplex are not 100% complementary). The duplex can comprise at least about 1, 2, 3, 4, or 5 or mismatches. The duplex can comprise at most about 1, 2, 3, 4, or 5 or mismatches. The duplex can comprise no more than 2 mismatches.

Bulges

In some cases, there can be a "bulge" in the duplex between the minimum CRISPR RNA and the minimum tracrRNA. A bulge is an unpaired region of nucleotides within the duplex. A bulge can contribute to the binding of the duplex to the site-directed polypeptide. The bulge can comprise, on one side of the duplex, an unpaired 5'-XXXY-3' where X is any purine and Y comprises a nucleotide that can form a wobble pair with a nucleotide on the opposite strand, and an unpaired nucleotide region on the other side of the duplex. The number of unpaired nucleotides on the two sides of the duplex can be different.

In one example, the bulge can comprise an unpaired purine (e.g., adenine) on the minimum CRISPR repeat strand of the bulge. In some examples, the bulge can comprise an unpaired 5'-AAGY-3' of the minimum tracrRNA sequence strand of the bulge, where Y comprises a nucleotide that can form a wobble pairing with a nucleotide on the minimum CRISPR repeat strand.

A bulge on the minimum CRISPR repeat side of the duplex can comprise at least 1, 2, 3, 4, or 5 or more unpaired nucleotides. A bulge on the minimum CRISPR repeat side of the duplex can comprise at most 1, 2, 3, 4, or 5 or more unpaired nucleotides. A bulge on the minimum CRISPR repeat side of the duplex can comprise 1 unpaired nucleotide.

A bulge on the minimum tracrRNA sequence side of the duplex can comprise at least 1, 2, 3, 4, 5, 6, 7, 8, 9, or 10 or more unpaired nucleotides. A bulge on the minimum tracrRNA sequence side of the duplex can comprise at most 1, 2, 3, 4, 5, 6, 7, 8, 9, or 10 or more unpaired nucleotides. A bulge on a second side of the duplex (e.g., the minimum tracrRNA sequence side of the duplex) can comprise 4 unpaired nucleotides.

A bulge can comprise at least one wobble pairing. In some examples, a bulge can comprise at most one wobble pairing. A bulge can comprise at least one purine nucleotide. A bulge can comprise at least 3 purine nucleotides. A bulge sequence can comprise at least 5 purine nucleotides. A bulge sequence can comprise at least one guanine nucleotide. In some examples, a bulge sequence can comprise at least one adenine nucleotide.

Hairpins

In various examples, one or more hairpins can be located 3' to the minimum tracrRNA in the 3' tracrRNA sequence.

The hairpin can start at least about 1, 2, 3, 4, 5, 6, 7, 8, 9, 10, 15, or 20 or more nucleotides 3' from the last paired nucleotide in the minimum CRISPR repeat and minimum tracrRNA sequence duplex. The hairpin can start at most about 1, 2, 3, 4, 5, 6, 7, 8, 9 or 10 or more nucleotides 3' of the last paired nucleotide in the minimum CRISPR repeat and minimum tracrRNA sequence duplex.

The hairpin can comprise at least about 1, 2, 3, 4, 5, 6, 7, 8, 9, 10, 15, or 20 or more consecutive nucleotides. The hairpin can comprise at most about 1, 2, 3, 4, 5, 6, 7, 8, 9, 10, 15, or more consecutive nucleotides.

The hairpin can comprise a CC dinucleotide (i.e., two consecutive cytosine nucleotides).

The hairpin can comprise duplexed nucleotides (e.g., nucleotides in a hairpin, hybridized together). For example, a hairpin can comprise a CC dinucleotide that is hybridized to a GG dinucleotide in a hairpin duplex of the 3' tracrRNA sequence.

One or more of the hairpins can interact with guide RNA-interacting regions of a site-directed polypeptide.

In some examples, there are two or more hairpins, and in other examples there are three or more hairpins.

3' tracrRNA Sequence

A 3' tracrRNA sequence can comprise a sequence with at least about 30%, about 40%, about 50%, about 60%, about 65%, about 70%, about 75%, about 80%, about 85%, about 90%, about 95%, or 100% sequence identity to a reference tracrRNA sequence (e.g., a tracrRNA from S. pyogenes).

The 3' tracrRNA sequence can have a length from about 6 nucleotides to about 100 nucleotides. For example, the 3' tracrRNA sequence can have a length from about 6 nucleotides (nt) to about 50 nt, from about 6 nt to about 40 nt, from about 6 nt to about 30 nt, from about 6 nt to about 25 nt, from about 6 nt to about 20 nt, from about 6 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt, or from about 15 nt to about 25 nt. The 3' tracrRNA sequence can have a length of approximately 14 nucleotides.

The 3' tracrRNA sequence can be at least about 60% identical to a reference 3' tracrRNA sequence (e.g., wild type 3' tracrRNA sequence from S. pyogenes) over a stretch of at least 6, 7, or 8 contiguous nucleotides. For example, the 3' tracrRNA sequence can be at least about 60% identical, about 65% identical, about 70% identical, about 75% identical, about 80% identical, about 85% identical, about 90% identical, about 95% identical, about 98% identical, about 99% identical, or 100% identical, to a reference 3' tracrRNA sequence (e.g., wild type 3' tracrRNA sequence from S. pyogenes) over a stretch of at least 6, 7, or 8 contiguous nucleotides.

The 3' tracrRNA sequence can comprise more than one duplexed region (e.g., hairpin, hybridized region). The 3' tracrRNA sequence can comprise two duplexed regions.

The 3' tracrRNA sequence can comprise a stem loop structure. The stem loop structure in the 3' tracrRNA can comprise at least 1, 2, 3, 4, 5, 6, 7, 8, 9, 10, 15 or 20 or more nucleotides. The stem loop structure in the 3' tracrRNA can comprise at most 1, 2, 3, 4, 5, 6, 7, 8, 9 or 10 or more nucleotides. The stem loop structure can comprise a functional moiety. For example, the stem loop structure can comprise an aptamer, a ribozyme, a protein-interacting hairpin, a CRISPR array, an intron, or an exon. The stem loop structure can comprise at least about 1, 2, 3, 4, or 5 or more functional moieties. The stem loop structure can comprise at most about 1, 2, 3, 4, or 5 or more functional moieties.

The hairpin in the 3' tracrRNA sequence can comprise a P-domain. In some examples, the P-domain can comprise a double-stranded region in the hairpin.

tracrRNA Extension Sequence

A tracrRNA extension sequence may be provided whether the tracrRNA is in the context of single-molecule guides or double-molecule guides. The tracrRNA extension sequence can have a length from about 1 nucleotide to about 400 nucleotides. The tracrRNA extension sequence can have a length of more than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, or 400 nucleotides. The tracrRNA extension sequence can have a length from about 20 to about 5000 or more nucleotides. The tracrRNA extension sequence can have a length of more than 1000 nucleotides. The tracrRNA extension sequence can have a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400 or more nucleotides. The tracrRNA extension sequence can have a length of less than 1000 nucleotides. The tracrRNA extension sequence can comprise less than 10 nucleotides in length. The tracrRNA extension sequence can be 10-30 nucleotides in length. The tracrRNA extension sequence can be 30-70 nucleotides in length.

The tracrRNA extension sequence can comprise a functional moiety (e.g., a stability control sequence, ribozyme, endoribonuclease binding sequence). The functional moiety can comprise a transcriptional terminator segment (i.e., a transcription termination sequence). The functional moiety can have a total length from about 10 nucleotides (nt) to about 100 nucleotides, from about 10 nt to about 20 nt, from about 20 nt to about 30 nt, from about 30 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt, from about 15 nt to about 80 nt, from about 90 nt to about 100 nt, from about 15 nt to about 50 nt, from about 15 nt to about 40 nt, from about 15 nt to about 30 nt, or from about 15 nt to about 25 nt. The functional moiety can function in a eukaryotic cell. The functional moiety can function in a prokaryotic cell. The functional moiety can function in both eukaryotic and prokaryotic cells.

Non-limiting examples of suitable tracrRNA extension functional moieties include a 3' poly-adenylated tail, a riboswitch sequence (e.g., to allow for regulated stability and/or regulated accessibility by proteins and protein complexes), a sequence that forms a dsRNA duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like). The tracrRNA extension sequence can comprise a primer binding site or a molecular index (e.g., barcode sequence). The tracrRNA extension sequence can comprise one or more affinity tags.

Single-Molecule Guide Linker Sequence

The linker sequence of a single-molecule guide nucleic acid can have a length from about 3 nucleotides to about 100 nucleotides. In Jinek et al., supra, for example, a simple 4 nucleotide "tetraloop" (-GAAA-) was used, Science, 337 (6096):816-821 (2012). An illustrative linker has a length from about 3 nucleotides (nt) to about 90 nt, from about 3 nt to about 80 nt, from about 3 nt to about 70 nt, from about 3 nt to about 60 nt, from about 3 nt to about 50 nt, from about 3 nt to about 40 nt, from about 3 nt to about 30 nt, from about 3 nt to about 20 nt, from about 3 nt to about 10 nt. For example, the linker can have a length from about 3 nt to about 5 nt, from about 5 nt to about 10 nt, from about 10 nt to about 15 nt, from about 15 nt to about 20 nt, from about 20 nt to about 25 nt, from about 25 nt to about 30 nt, from about 30 nt to about 35 nt, from about 35 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt. The linker of a single-molecule guide nucleic acid can be between 4 and 40 nucleotides. The linker can be at least about 100, 500, 1000, 1500, 2000, 2500, 3000, 3500, 4000, 4500, 5000, 5500, 6000, 6500, or 7000 or more nucleotides. The linker can be at most about 100, 500, 1000, 1500, 2000, 2500, 3000, 3500, 4000, 4500, 5000, 5500, 6000, 6500, or 7000 or more nucleotides.

Linkers can comprise any of a variety of sequences, although in some examples the linker will not comprise sequences that have extensive regions of homology with other portions of the guide RNA, which might cause intramolecular binding that could interfere with other functional regions of the guide. In Jinek et al., supra, a simple 4 nucleotide sequence -GAAA- was used, Science, 337 (6096):816-821 (2012), but numerous other sequences, including longer sequences can likewise be used.

The linker sequence can comprise a functional moiety. For example, the linker sequence can comprise one or more features, including an aptamer, a ribozyme, a protein-interacting hairpin, a protein binding site, a CRISPR array, an intron, or an exon. The linker sequence can comprise at least about 1, 2, 3, 4, or 5 or more functional moieties. In some examples, the linker sequence can comprise at most about 1, 2, 3, 4, or 5 or more functional moieties.

Nucleic Acid Modifications (Chemical and Structural Modifications)

In some aspects, polynucleotides introduced into cells can comprise one or more modifications that can be used individually or in combination, for example, to enhance activity, stability or specificity, alter delivery, reduce innate immune responses in host cells, or for other enhancements, as further described herein and known in the art.

In certain examples, modified polynucleotides can be used in the CRISPR/Cas9 or CRISPR/Cpf1 system, in which case the guide RNAs (either single-molecule guides or double-molecule guides) and/or a DNA or an RNA encoding a Cas9 or Cpf1 endonuclease introduced into a cell can be modified, as described and illustrated below. Such modified polynucleotides can be used in the CRISPR/Cas9 or CRISPR/Cpf1 system to edit any one or more genomic loci.

Using the CRISPR/Cas9 or CRISPR/Cpf1 system for purposes of non-limiting illustrations of such uses, modifications of guide RNAs can be used to enhance the formation or stability of the CRISPR/Cas9 or CRISPR/Cpf1 genome editing complex comprising guide RNAs, which can be single-molecule guides or double-molecule, and a Cas9 or Cpf1 endonuclease. Modifications of guide RNAs can also or alternatively be used to enhance the initiation, stability or kinetics of interactions between the genome editing complex with the target sequence in the genome, which can be used, for example, to enhance on-target activity. Modifications of guide RNAs can also or alternatively be used to enhance specificity, e.g., the relative rates of genome editing at the on-target site as compared to effects at other (off-target) sites.

Modifications can also or alternatively be used to increase the stability of a guide RNA, e.g., by increasing its resistance to degradation by ribonucleases (RNases) present in a cell, thereby causing its half-life in the cell to be increased. Modifications enhancing guide RNA half-life can be particularly useful in aspects in which a Cas9 or Cpf1 endonuclease is introduced into the cell to be edited via an RNA that needs to be translated in order to generate endonuclease, because increasing the half-life of guide RNAs introduced at the same time as the RNA encoding the endonuclease can be used to increase the time that the guide RNAs and the encoded Cas9 or Cpf1 endonuclease co-exist in the cell.

Modifications can also or alternatively be used to decrease the likelihood or degree to which RNAs introduced into cells elicit innate immune responses. Such responses, which have been well characterized in the context of RNA interference (RNAi), including small-interfering RNAs (siRNAs), as described below and in the art, tend to be associated with reduced half-life of the RNA and/or the elicitation of cytokines or other factors associated with immune responses.

One or more types of modifications can also be made to RNAs encoding an endonuclease that are introduced into a cell, including, without limitation, modifications that enhance the stability of the RNA (such as by increasing its degradation by RNases present in the cell), modifications that enhance translation of the resulting product (i.e. the endonuclease), and/or modifications that decrease the likelihood or degree to which the RNAs introduced into cells elicit innate immune responses.

Combinations of modifications, such as the foregoing and others, can likewise be used. In the case of CRISPR/Cas9 or CRISPR/Cpf1, for example, one or more types of modifications can be made to guide RNAs (including those exemplified above), and/or one or more types of modifications can be made to RNAs encoding Cas endonuclease (including those exemplified above).

By way of illustration, guide RNAs used in the CRISPR/Cas9 or CRISPR/Cpf1 system, or other smaller RNAs can be readily synthesized by chemical means, enabling a number of modifications to be readily incorporated, as illustrated below and described in the art. While chemical synthetic procedures are continually expanding, purifications of such RNAs by procedures such as high-performance liquid chromatography (HPLC, which avoids the use of gels such as PAGE) tends to become more challenging as polynucleotide lengths increase significantly beyond a hundred or so nucleotides. One approach that can be used for generating chemically-modified RNAs of greater length is to produce two or more molecules that are ligated together. Much longer RNAs, such as those encoding a Cas9 endonuclease, are more readily generated enzymatically. While fewer types of modifications are available for use in enzymatically produced RNAs, there are still modifications that can be used to, e.g., enhance stability, reduce the likelihood or degree of innate immune response, and/or enhance other attributes, as described further below and in the art; and new types of modifications are regularly being developed.

By way of illustration of various types of modifications, especially those used frequently with smaller chemically synthesized RNAs, modifications can comprise one or more nucleotides modified at the 2' position of the sugar, in some aspects a 2'-O-alkyl, 2'-O-alkyl-O-alkyl, or 2'-fluoro-modified nucleotide. In some examples, RNA modifications include 2'-fluoro, 2'-amino or 2'-O-methyl modifications on the ribose of pyrimidines, abasic residues, or an inverted base at the 3' end of the RNA. Such modifications are routinely incorporated into oligonucleotides and these oligonucleotides have been shown to have a higher Tm (i.e., higher target binding affinity) than 2'-deoxyoligonucleotides against a given target.

A number of nucleotide and nucleoside modifications have been shown to make the oligonucleotide into which they are incorporated more resistant to nuclease digestion than the native oligonucleotide; these modified oligos survive intact for a longer time than unmodified oligonucleotides. Specific examples of modified oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. Some oligonucleotides are oligonucleotides with phosphorothioate backbones and those with heteroatom backbones, particularly $CH_2$—NH—O—$CH_2$, CH, ~N($CH_3$)~O~$CH_2$ (known as a methylene(methylimino) or MMI backbone), $CH_2$—O—N($CH_3$)—$CH_2$, $CH_2$—N($CH_3$)—N($CH_3$)—$CH_2$ and O—N($CH_3$)—$CH_2$—$CH_2$ backbones, wherein the native phosphodiester backbone is represented as O—P—O—$CH_2$); amide backbones [see De Mesmaeker et al., Ace. Chem. Res., 28:366-374 (1995)]; morpholino backbone structures (see Summerton and Weller, U.S. Pat. No. 5,034,506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone, see Nielsen et al., Science 1991, 254, 1497). Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050.

Morpholino-based oligomeric compounds are described in Braasch and David Corey, Biochemistry, 41(14): 4503-4510 (2002); Genesis, Volume 30, Issue 3, (2001); Heasman, Dev. Biol., 243: 209-214 (2002); Nasevicius et al., Nat. Genet., 26:216-220 (2000); Lacerra et al., Proc. Natl. Acad. Sci., 97: 9591-9596 (2000); and U.S. Pat. No. 5,034,506, issued Jul. 23, 1991.

Cyclohexenyl nucleic acid oligonucleotide mimetics are described in Wang et al., J. Am. Chem. Soc., 122: 8595-8602 (2000).

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and $CH_2$ component parts; see U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439.

One or more substituted sugar moieties can also be included, e.g., one of the following at the 2' position: OH, SH, $SCH_3$, F, OCN, $OCH_3OCH_3$, $OCH_3O(CH_2)nCH_3$, $O(CH_2)nNH_2$, or $O(CH_2)nCH_3$, where n is from 1 to about 10; C1 to C10 lower alkyl, alkoxyalkoxy, substituted lower alkyl, alkaryl or aralkyl; Cl; Br; CN; $CF_3$; $OCF_3$; O-, S-, or N-alkyl; O-, S-, or N-alkenyl; $SOCH_3$; $SO_2CH_3$; $ONO_2$; $NO_2$; $N_3$; $NH_2$; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. In some aspects, a modification includes 2'-methoxyethoxy (2'-O—$CH_2CH_2OCH_3$, also known as 2'-O-(2-methoxyethyl)) (Martin et al, Helv. Chim. Acta, 1995, 78, 486). Other modifications include 2'-methoxy (2'-O—$CH_3$), 2'-propoxy (2'-$OCH_2CH_2CH_3$) and 2'-fluoro (2'-F). Similar modifications may also be made at other positions on the oligonucleotide, particularly the 3' position of the sugar on the 3' terminal nucleotide and the 5' position of 5' terminal nucleotide. Oligonucleotides may also have sugar mimetics, such as cyclobutyls in place of the pentofuranosyl group.

In some examples, both a sugar and an internucleoside linkage, i.e., the backbone, of the nucleotide units can be replaced with novel groups. The base units can be maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide can be replaced with an amide containing backbone, for example, an aminoethylglycine backbone. The nucleobases can be retained and bound directly or indirectly to aza nitrogen atoms of the amide portion of the backbone. Representative U.S. patents that teach the preparation of PNA compounds comprise, but are not limited to, U.S. Pat. Nos. 5,539,082; 5,714,331; and 5,719,262. Further teaching of PNA compounds can be found in Nielsen et al, Science, 254: 1497-1500 (1991).

Guide RNAs can also include, additionally or alternatively, nucleobase (often referred to in the art simply as "base") modifications or substitutions. As used herein, "unmodified" or "natural" nucleobases include adenine (A), guanine (G), thymine (T), cytosine (C), and uracil (U). Modified nucleobases include nucleobases found only infrequently or transiently in natural nucleic acids, e.g., hypoxanthine, 6-methyladenine, 5-Me pyrimidines, particularly 5-methylcytosine (also referred to as 5-methyl-2' deoxycytosine and often referred to in the art as 5-Me-C), 5-hydroxymethylcytosine (HMC), glycosyl HMC and gentobiosyl HMC, as well as synthetic nucleobases, e.g., 2-aminoadenine, 2-(methylamino) adenine, 2-(imidazolylalkyl)adenine, 2-(aminoalklyamino) adenine or other heterosubstituted alkyladenines, 2-thiouracil, 2-thiothymine, 5-bromouracil, 5-hydroxymethyluracil, 8-azaguanine, 7-deazaguanine, N6 (6-aminohexyl) adenine, and 2,6-diaminopurine. Kornberg, A., DNA Replication, W. H. Freeman & Co., San Francisco, pp. 75-77 (1980); Gebeyehu et al., Nucl. Acids Res. 15:4513 (1997). A "universal" base known in the art, e.g., inosine, can also be included. 5-Me-C substitutions have been shown to increase nucleic acid duplex stability by 0.6-1.2° C. (Sanghvi, Y. S., in Crooke, S. T. and Lebleu, B., eds., Antisense Research and Applications, CRC Press, Boca Raton, 1993, pp. 276-278) and are aspects of base substitutions.

Modified nucleobases can comprise other synthetic and natural nucleobases, such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazaguanine and 7-deazaadenine, and 3-deazaguanine and 3-deazaadenine.

Further, nucleobases can comprise those disclosed in U.S. Pat. No. 3,687,808, those disclosed in 'The Concise Encyclopedia of Polymer Science And Engineering', pages 858-859, Kroschwitz, J. I., ed. John Wiley & Sons, 1990, those disclosed by Englisch et al., Angewandle Chemie, International Edition', 1991, 30, page 613, and those disclosed by Sanghvi, Y. S., Chapter 15, Antisense Research and Applications', pages 289-302, Crooke, S. T. and Lebleu, B. ea., CRC Press, 1993. Certain of these nucleobases are particularly useful for increasing the binding affinity of the oligomeric compounds of the present disclosure. These include 5-substituted pyrimidines, 6-azapyrimidines and N-2, N-6 and 0-6 substituted purines, comprising 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., eds, 'Antisense Research and Applications', CRC Press, Boca Raton, 1993, pp. 276-278) and are aspects of base substitutions, even more particularly when combined with 2'-O-methoxyethyl sugar modifications. Modified nucleobases are described in U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,596,091; 5,614,617; 5,681,941; 5,750,692; 5,763,588; 5,830,653; 6,005,096; and U.S. Patent Application Publication 2003/0158403.

Thus, the term "modified" refers to a non-natural sugar, phosphate, or base that is incorporated into a guide RNA, an endonuclease, or both a guide RNA and an endonuclease. It is not necessary for all positions in a given oligonucleotide to be uniformly modified, and in fact more than one of the aforementioned modifications can be incorporated in a single oligonucleotide, or even in a single nucleoside within an oligonucleotide.

The guide RNAs and/or mRNA (or DNA) encoding an endonuclease can be chemically linked to one or more moieties or conjugates that enhance the activity, cellular distribution, or cellular uptake of the oligonucleotide. Such moieties comprise, but are not limited to, lipid moieties such as a cholesterol moiety [Letsinger et al., Proc. Natl. Acad. Sci. USA, 86: 6553-6556 (1989)]; cholic acid [Manoharan et al., Bioorg. Med. Chem. Let., 4: 1053-1060 (1994)]; a thioether, e.g., hexyl-S-tritylthiol [Manoharan et al, Ann. N. Y. Acad. Sci., 660: 306-309 (1992) and Manoharan et al., Bioorg. Med. Chem. Let., 3: 2765-2770 (1993)]; a thiocholesterol [Oberhauser et al., Nucl. Acids Res., 20: 533-538 (1992)]; an aliphatic chain, e.g., dodecandiol or undecyl residues [Kabanov et al., FEBS Lett., 259: 327-330 (1990) and Svinarchuk et al., Biochimie, 75: 49-54 (1993)]; a phospholipid, e.g., di-hexadecyl-rac-glycerol or triethylammonium 1,2-di-O-hexadecyl-rac-glycero-3-H-phosphonate [Manoharan et al., Tetrahedron Lett., 36: 3651-3654 (1995) and Shea et al., Nucl. Acids Res., 18: 3777-3783 (1990)]; a polyamine or a polyethylene glycol chain [Mancharan et al., Nucleosides & Nucleotides, 14: 969-973 (1995)]; adamantane acetic acid [Manoharan et al., Tetrahedron Lett., 36: 3651-3654 (1995)]; a palmityl moiety [(Mishra et al., Biochim. Biophys. Acta, 1264: 229-237 (1995)]; or an octadecylamine or hexylamino-carbonyl-t oxycholesterol moiety [Crooke et al., J. Pharmacol. Exp. Ther., 277: 923-937 (1996)]. See also U.S. Pat. Nos. 4,828,979; 4,948,882; 5,218,105; 5,525,465; 5,541,313; 5,545,730; 5,552,538; 5,578,717; 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

Sugars and other moieties can be used to target proteins and complexes comprising nucleotides, such as cationic polysomes and liposomes, to particular sites. For example, hepatic cell directed transfer can be mediated via asialoglycoprotein receptors (ASGPRs); see, e.g., Hu, et al., Protein Pept Lett. 21(10):1025-30 (2014). Other systems known in the art and regularly developed can be used to target biomolecules of use in the present case and/or complexes thereof to particular target cells of interest.

These targeting moieties or conjugates can include conjugate groups covalently bound to functional groups, such as primary or secondary hydroxyl groups. Conjugate groups of the present disclosure include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this present disclosure, include groups that improve uptake, enhance resistance to degradation, and/or strengthen sequence-specific hybridization with the target nucleic acid. Groups that enhance the pharmacokinetic properties, in the context of this present disclosure, include groups that improve uptake, distribution, metabolism or excretion of the compounds of the present disclosure. Representative conjugate groups are disclosed in International Patent Application No. PCT/US92/09196, filed Oct. 23, 1992 (published as WO1993007883), and U.S. Pat. No. 6,287,860. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy cholesterol moiety. See, e.g., U.S. Pat. Nos. 4,828,979; 4,948,882; 5,218,105; 5,525,465; 5,541,313; 5,545,730; 5,552,538; 5,578,717; 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

Longer polynucleotides that are less amenable to chemical synthesis and are typically produced by enzymatic synthesis can also be modified by various means. Such modifications can include, for example, the introduction of certain nucleotide analogs, the incorporation of particular sequences or other moieties at the 5' or 3' ends of molecules, and other modifications. By way of illustration, the mRNA encoding Cas9 is approximately 4 kb in length and can be synthesized by in vitro transcription. Modifications to the mRNA can be applied to, e.g., increase its translation or stability (such as by increasing its resistance to degradation with a cell), or to reduce the tendency of the RNA to elicit an innate immune response that is often observed in cells following introduction of exogenous RNAs, particularly longer RNAs such as that encoding Cas9.

Numerous such modifications have been described in the art, such as polyA tails, 5' cap analogs (e.g., Anti Reverse Cap Analog (ARCA) or m7G(5')ppp(5')G (mCAP)), modified 5' or 3' untranslated regions (UTRs), use of modified bases (such as Pseudo-UTP, 2-Thio-UTP, 5-Methylcytidine-5'-Triphosphate (5-Methyl-CTP) or N6-Methyl-ATP), or treatment with phosphatase to remove 5' terminal phosphates. These and other modifications are known in the art, and new modifications of RNAs are regularly being developed.

There are numerous commercial suppliers of modified RNAs, including for example, TriLink Biotech, AxoLabs, Bio-Synthesis Inc., Dharmacon and many others. As described by TriLink, for example, 5-Methyl-CTP can be used to impart desirable characteristics, such as increased nuclease stability, increased translation or reduced interaction of innate immune receptors with in vitro transcribed RNA. 5-Methylcytidine-5'-Triphosphate (5-Methyl-CTP), N6-Methyl-ATP, as well as Pseudo-UTP and 2-Thio-UTP, have also been shown to reduce innate immune stimulation in culture and in vivo while enhancing translation, as illustrated in publications by Kormann et al. and Warren et al. referred to below.

It has been shown that chemically modified mRNA delivered in vivo can be used to achieve improved therapeutic effects; see, e.g., Kormann et al., Nature Biotechnology 29, 154-157 (2011). Such modifications can be used, for example, to increase the stability of the RNA molecule and/or reduce its immunogenicity. Using chemical modifications such as Pseudo-U, N6-Methyl-A, 2-Thio-U and 5-Methyl-C, it was found that substituting just one quarter of the uridine and cytidine residues with 2-Thio-U and 5-Methyl-C respectively resulted in a significant decrease in toll-like receptor (TLR) mediated recognition of the mRNA in mice. By reducing the activation of the innate immune system, these modifications can be used to effectively increase the stability and longevity of the mRNA in vivo; see, e.g., Kormann et al., supra.

It has also been shown that repeated administration of synthetic messenger RNAs incorporating modifications designed to bypass innate anti-viral responses can reprogram differentiated human cells to pluripotency. See, e.g., Warren, et al., Cell Stem Cell, 7(5):618-30 (2010). Such modified mRNAs that act as primary reprogramming proteins can be an efficient means of reprogramming multiple human cell types. Such cells are referred to as induced pluripotency stem cells (iPSCs), and it was found that enzymatically synthesized RNA incorporating 5-Methyl-CTP, Pseudo-UTP and an Anti Reverse Cap Analog (ARCA) could be used to effectively evade the cell's antiviral response; see, e.g., Warren et al., supra.

Other modifications of polynucleotides described in the art include, for example, the use of polyA tails, the addition of 5' cap analogs (such as m7G(5')ppp(5')G (mCAP)), modifications of 5' or 3' untranslated regions (UTRs), or treatment with phosphatase to remove 5' terminal phosphates—and new approaches are regularly being developed.

A number of compositions and techniques applicable to the generation of modified RNAs for use herein have been developed in connection with the modification of RNA interference (RNAi), including small-interfering RNAs (siRNAs). siRNAs present particular challenges in vivo because their effects on gene silencing via mRNA interference are generally transient, which can require repeat administration. In addition, siRNAs are double-stranded RNAs (dsRNA) and mammalian cells have immune responses that have evolved to detect and neutralize dsRNA, which is often a by-product of viral infection. Thus, there are mammalian enzymes such as PKR (dsRNA-responsive kinase), and potentially retinoic acid-inducible gene I (RIG-I), that can mediate cellular responses to dsRNA, as well as Toll-like receptors (such as TLR3, TLR7 and TLR8) that can trigger the induction of cytokines in response to such molecules; see, e.g., the reviews by Angart et al., Pharmaceuticals (Basel) 6(4): 440-468 (2013); Kanasty et al., Molecular Therapy 20(3): 513-524 (2012); Burnett et al., Biotechnol J. 6(9):1130-46 (2011); Judge and MacLachlan, Hum Gene Ther 19(2):111-24 (2008); and references cited therein.

A large variety of modifications have been developed and applied to enhance RNA stability, reduce innate immune responses, and/or achieve other benefits that can be useful in connection with the introduction of polynucleotides into human cells, as described herein; see, e.g., the reviews by Whitehead K A et al., Annual Review of Chemical and Biomolecular Engineering, 2: 77-96 (2011); Gaglione and Messere, Mini Rev Med Chem, 10(7):578-95 (2010); Chernolovskaya et al, Curr Opin Mol Ther., 12(2):158-67 (2010); Deleavey et al., Curr Protoc Nucleic Acid Chem Chapter 16: Unit 16.3 (2009); Behlke, Oligonucleotides 18(4):305-19 (2008); Fucini et al., Nucleic Acid Ther 22(3): 205-210 (2012); Bremsen et al., Front Genet 3:154 (2012).

As noted above, there are a number of commercial suppliers of modified RNAs, many of which have specialized in modifications designed to improve the effectiveness of siRNAs. A variety of approaches are offered based on various findings reported in the literature. For example, Dharmacon notes that replacement of a non-bridging oxygen with sulfur (phosphorothioate, PS) has been extensively used to improve nuclease resistance of siRNAs, as reported by Kole, Nature Reviews Drug Discovery 11:125-140 (2012). Modifications of the 2'-position of the ribose have been reported to improve nuclease resistance of the internucleotide phosphate bond while increasing duplex stability (Tm), which has also been shown to provide protection from immune activation. A combination of moderate PS backbone modifications with small, well-tolerated 2'-substitutions (2'-O-Methyl, 2'-Fluoro, 2'-Hydro) have been associated with highly stable siRNAs for applications in vivo, as reported by Soutschek et al. Nature 432:173-178 (2004); and 2'-O-Methyl modifications have been reported to be effective in improving stability as reported by Volkov, Oligonucleotides 19:191-202 (2009). With respect to decreasing the induction of innate immune responses, modifying specific sequences with 2'-O-Methyl, 2'-Fluoro, 2'-Hydro have been reported to reduce TLR7/TLR8 interaction while generally preserving silencing activity; see, e.g., Judge et al., Mol. Ther. 13:494-505 (2006); and Cekaite et al., J. Mol. Biol. 365:90-108 (2007). Additional modifications, such as 2-thiouracil, pseudouracil, 5-methylcytosine, 5-methyluracil, and N6-methyladenosine have also been shown to minimize the immune effects mediated by TLR3, TLR7, and TLR8; see, e.g., Kariko, K. et al., Immunity 23:165-175 (2005).

As is also known in the art, and commercially available, a number of conjugates can be applied to polynucleotides, such as RNAs, for use herein that can enhance their delivery and/or uptake by cells, including for example, cholesterol, tocopherol and folic acid, lipids, peptides, polymers, linkers and aptamers; see, e.g., the review by Winkler, Ther. Deliv. 4:791-809 (2013), and references cited therein.

Codon-Optimization

A polynucleotide encoding a site-directed polypeptide can be codon-optimized according to methods standard in the art for expression in the cell containing the target DNA of interest. For example, if the intended target nucleic acid is in a human cell, a human codon-optimized polynucleotide encoding Cas9 is contemplated for use for producing the Cas9 polypeptide.

Complexes of a Genome-Targeting Nucleic Acid and a Site-Directed Polypeptide

A genome-targeting nucleic acid interacts with a site-directed polypeptide (e.g., a nucleic acid-guided nuclease such as Cas9), thereby forming a complex. The genome-targeting nucleic acid guides the site-directed polypeptide to a target nucleic acid.

Ribonucleoprotein Complexes (RNPs)

The site-directed polypeptide and genome-targeting nucleic acid can each be administered separately to a cell or a patient. On the other hand, the site-directed polypeptide can be pre-complexed with one or more guide RNAs, or one or more crRNA together with a tracrRNA. The pre-complexed material can then be administered to a cell or a patient. Such pre-complexed material is known as a ribonucleoprotein particle (RNP). The site-directed polypeptide in the RNP can be, for example, a Cas9 endonuclease or a Cpf1 endonuclease. The site-directed polypeptide can be flanked at the N-terminus, the C-terminus, or both the N-terminus and C-terminus by one or more nuclear localization signals (NLSs). For example, a Cas9 endonuclease can be flanked by two NLSs, one NLS located at the N-terminus and the second NLS located at the C-terminus. The NLS can be any NLS known in the art, such as a SV40 NLS. The weight ratio of genome-targeting nucleic acid to site-directed polypeptide in the RNP can be 1:1. For example, the weight ratio of sgRNA to Cas9 endonuclease in the RNP can be 1:1.

Nucleic Acids Encoding System Components

The present disclosure provides a nucleic acid comprising a nucleotide sequence encoding a genome-targeting nucleic acid of the disclosure, a site-directed polypeptide of the disclosure, and/or any nucleic acid or proteinaceous molecule necessary to carry out the aspects of the methods of the disclosure.

The nucleic acid encoding a genome-targeting nucleic acid of the disclosure, a site-directed polypeptide of the disclosure, and/or any nucleic acid or proteinaceous molecule necessary to carry out the aspects of the methods of the disclosure can comprise a vector (e.g., a recombinant expression vector).

The term "vector" refers to a nucleic acid molecule capable of transporting another nucleic acid to which it has been linked. One type of vector is a "plasmid", which refers to a circular double-stranded DNA loop into which additional nucleic acid segments can be ligated. Another type of vector is a viral vector, wherein additional nucleic acid segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome.

In some examples, vectors can be capable of directing the expression of nucleic acids to which they are operatively linked. Such vectors are referred to herein as "recombinant expression vectors", or more simply "expression vectors", which serve equivalent functions.

The term "operably linked" means that the nucleotide sequence of interest is linked to regulatory sequence(s) in a manner that allows for expression of the nucleotide sequence. The term "regulatory sequence" is intended to include, for example, promoters, enhancers and other expression control elements (e.g., polyadenylation signals). Such regulatory sequences are well known in the art and are described, for example, in Goeddel; Gene Expression Technology: Methods in Enzymology 185, Academic Press, San Diego, Calif. (1990). Regulatory sequences include those that direct constitutive expression of a nucleotide sequence in many types of host cells, and those that direct expression of the nucleotide sequence only in certain host cells (e.g., tissue-specific regulatory sequences). It will be appreciated by those skilled in the art that the design of the expression vector can depend on such factors as the choice of the target cell, the level of expression desired, and the like.

Expression vectors contemplated include, but are not limited to, viral vectors based on vaccinia virus, poliovirus, adenovirus, adeno-associated virus, SV40, herpes simplex virus, human immunodeficiency virus, retrovirus (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus) and other recombinant vectors. Other vectors contemplated for eukaryotic target cells include, but are not limited to, the vectors pXT1, pSG5, pSVK3, pBPV, pMSG, and pSVLSV40 (Pharmacia). Other vectors can be used so long as they are compatible with the host cell.

In some examples, a vector can comprise one or more transcription and/or translation control elements. Depending on the host/vector system utilized, any of a number of suitable transcription and translation control elements, including constitutive and inducible promoters, transcription enhancer elements, transcription terminators, etc. can be used in the expression vector. The vector can be a self-inactivating vector that either inactivates the viral sequences or the components of the CRISPR machinery or other elements.

Non-limiting examples of suitable eukaryotic promoters (i.e., promoters functional in a eukaryotic cell) include those from cytomegalovirus (CMV) immediate early, herpes simplex virus (HSV) thymidine kinase, early and late SV40, long terminal repeats (LTRs) from retrovirus, human elongation factor-1 promoter (EF1), a hybrid construct comprising the cytomegalovirus (CMV) enhancer fused to the chicken beta-actin promoter (CAG), murine stem cell virus promoter (MSCV), phosphoglycerate kinase-1 locus promoter (PGK), and mouse metallothionein-I.

For expressing small RNAs, including guide RNAs used in connection with Cas endonuclease, various promoters such as RNA polymerase III promoters, including for example U6 and H1, can be advantageous. Descriptions of and parameters for enhancing the use of such promoters are known in art, and additional information and approaches are regularly being described; see, e.g., Ma, H. et al., *Molecular Therapy—Nucleic Acids* 3, e161 (2014) doi:10.1038/mtna.2014.12.

The expression vector can also contain a ribosome binding site for translation initiation and a transcription terminator. The expression vector can also comprise appropriate sequences for amplifying expression. The expression vector can also include nucleotide sequences encoding non-native tags (e.g., histidine tag, hemagglutinin tag, green fluorescent protein, etc.) that are fused to the site-directed polypeptide, thus resulting in a fusion protein.

A promoter can be an inducible promoter (e.g., a heat shock promoter, tetracycline-regulated promoter, steroid-regulated promoter, metal-regulated promoter, estrogen receptor-regulated promoter, etc.). The promoter can be a constitutive promoter (e.g., CMV promoter, UBC promoter). In some cases, the promoter can be a spatially restricted and/or temporally restricted promoter (e.g., a tissue specific promoter, a cell type specific promoter, etc.).

The nucleic acid encoding a genome-targeting nucleic acid of the disclosure and/or a site-directed polypeptide can be packaged into or on the surface of delivery vehicles for delivery to cells. Delivery vehicles contemplated include, but are not limited to, nanospheres, liposomes, quantum dots, nanoparticles, polyethylene glycol particles, hydrogels, and micelles. As described in the art, a variety of targeting moieties can be used to enhance the preferential interaction of such vehicles with desired cell types or locations.

Introduction of the complexes, polypeptides, and nucleic acids of the disclosure into cells can occur by viral or bacteriophage infection, transfection, conjugation, protoplast fusion, lipofection, electroporation, nucleofection, calcium phosphate precipitation, polyethyleneimine (PEI)-mediated transfection, DEAE-dextran mediated transfection, liposome-mediated transfection, particle gun technology, calcium phosphate precipitation, direct micro-injection, nanoparticle-mediated nucleic acid delivery, and the like.

Therapeutic Approach

Provided herein are methods for treating a patient with pain. An aspect of such method is an ex vivo cell-based therapy. For example, a biopsy of the patient's peripheral nerves is performed. The nerve tissue can be isolated from the patient's skin or leg. Then, a cell of the peripheral nervous system (e.g., a neuron or a glial cell such as Schwann cell in nerves or satellite glial cell in ganglia) is isolated from the biopsied material. Then, the chromosomal DNA of the cell of the peripheral nervous system (e.g., a neuron, or a glial cell such as Schwann cell in nerves or satellite glial cell in ganglia) can be edited using the materials and methods described herein. Finally, the edited cell of the peripheral nervous system (e.g., a neuron or a glial cell such as Schwann cell in nerves or satellite glial cell in ganglia) is implanted into the patient. Any source or type of cell may be used as the progenitor cell.

Another aspect of such method is an ex vivo cell-based therapy. For example, a patient specific induced pluripotent stem cell (iPSC) can be created. Then, the chromosomal DNA of these iPSC cells can be edited using the materials and methods described herein. Next, the genome-edited iPSCs can be differentiated into cells of the peripheral nervous system (e.g., a neuron or a glial cell such as Schwann cell in nerves or satellite glial cell in ganglia). Finally, the differentiated cells of the peripheral nervous system (e.g., a neuron or a glial cell such as Schwann cell in nerves or satellite glial cell in ganglia) are implanted into the patient.

Yet another aspect of such method is an ex vivo cell-based therapy. For example, a mesenchymal stem cell can be isolated from the patient, which can be isolated from the patient's bone marrow or peripheral blood. Next, the chromosomal DNA of these mesenchymal stem cells can be edited using the materials and methods described herein. Next, the genome-edited mesenchymal stem cells can be differentiated into cells of the peripheral nervous system (e.g., a neuron or a glial cell such as Schwann cell in nerves or satellite glial cell in ganglia). Finally, the differentiated cells of the peripheral nervous system (e.g., a neuron or a glial cell such as Schwann cell in nerves or satellite glial cell in ganglia) are implanted into the patient.

One advantage of an ex vivo cell therapy approach is the ability to conduct a comprehensive analysis of the therapeutic prior to administration. Nuclease-based therapeutics can have some level of off-target effects. Performing gene editing ex vivo allows one to characterize the edited cell population prior to implantation. The present disclosure includes sequencing the entire genome of the edited cells to ensure that the off-target effects, if any, can be in genomic locations associated with minimal risk to the patient. Furthermore, populations of specific cells, including clonal populations, can be isolated prior to implantation.

Another advantage of ex vivo cell therapy relates to genetic modification in iPSCs compared to other primary cell sources. iPSCs are prolific, making it easy to obtain the large number of cells that will be required for a cell-based therapy. Furthermore, iPSCs are an ideal cell type for performing clonal isolations. This allows screening for the correct genomic modification, without risking a decrease in viability. In contrast, other primary cells, such as glial cells, are viable for only a few passages and difficult to clonally expand. Thus, manipulation of iPSCs for the treatment of pain can be much easier, and can shorten the amount of time needed to make the desired genetic modification.

Methods can also include an in vivo based therapy. Chromosomal DNA of the cells in the patient is edited using the materials and methods described herein. In some aspects, the target cell in an in vivo based therapy is a neuron of the peripheral nervous system.

Although certain cells present an attractive target for ex vivo treatment and therapy, increased efficacy in delivery may permit direct in vivo delivery to such cells. Ideally the targeting and editing would be directed to the relevant cells. Cleavage in other cells can also be prevented by the use of promoters only active in certain cells and or developmental stages. Additional promoters are inducible, and therefore can be temporally controlled if the nuclease is delivered as a plasmid. The amount of time that delivered RNA and protein remain in the cell can also be adjusted using treatments or domains added to change the half-life. In vivo treatment would eliminate a number of treatment steps, but a lower rate of delivery can require higher rates of editing. In vivo treatment can eliminate problems and losses from ex vivo treatment and engraftment and post-engraftment integration of neurons and glial cells appropriately into existing brain circuits.

An advantage of in vivo gene therapy can be the ease of therapeutic production and administration. The same therapeutic approach and therapy will have the potential to be used to treat more than one patient, for example a number of patients who share the same or similar genotype or allele. In contrast, ex vivo cell therapy typically requires using a patient's own cells, which are isolated, manipulated and returned to the same patient.

Also provided herein is a cellular method for editing the SCN9A gene in a cell by genome editing. For example, a cell can be isolated from a patient or animal. Then, the chromosomal DNA of the cell can be edited using the materials and methods described herein.

The methods provided herein, regardless of whether a cellular or ex vivo or in vivo method, can involve reducing (knock-down) or eliminating (knock-out) the expression of the SCN9A gene by introducing one or more insertions, deletions or mutations within or near the SCN9A gene or other DNA sequences that encode regulatory elements of the SCN9A gene.

For example, the knock-down or knock-out strategy can involve disrupting the reading frame in the SCN9A gene by introducing random insertions or deletions (indels) that arise due to the imprecise NHEJ repair pathway. This can be achieved by inducing one single stranded break or double stranded break in the SCN9A gene with one or more CRISPR endonucleases and a gRNA (e.g., crRNA+tracrRNA, or sgRNA), or two or more single stranded breaks or double stranded breaks in the SCN9A gene with two or more CRISPR endonucleases and two or more sgRNAs. This approach can require development and optimization of sgRNAs for the SCN9A gene.

Alternatively, the knock-down or knock-out strategy can also involve deletion of one or more segments within or near the SCN9A gene or other DNA sequences that encode regulatory elements of the SCN9A gene. This deletion strategy requires at least a pair of gRNAs (e.g., crRNA+tracrRNA, or sgRNA) capable of binding to two different sites within or near the SCN9A gene and one or more CRISPR endonucleases. The CRISPR endonucleases, configured with the two gRNAs, induce two double stranded breaks at the desired locations. After cleavage, the two ends, regardless of whether blunt or with overhangs, can be joined by NHEJ, leading to the deletion of the intervening segment. In certain aspects, NHEJ repair pathways can lead to insertions, deletions or mutations at the joints.

In addition to the above genome editing strategies, another strategy involves modulating expression, function, or activity of SCN9A by editing in the regulatory sequence.

In addition to the editing options listed above, Cas9 or similar proteins can be used to target effector domains to the same target sites that can be identified for editing, or additional target sites within range of the effector domain. A range of chromatin modifying enzymes, methylases or demethylases can be used to alter expression of the target gene. One possibility is decreasing the expression of the SCN9A protein if a mutation leads to undesirable activity. These types of epigenetic regulation have some advantages, particularly as they are limited in possible off-target effects.

A number of types of genomic target sites can be present in addition to the coding and splicing sequences.

The regulation of transcription and translation implicates a number of different classes of sites that interact with cellular proteins or nucleotides. Often the DNA binding sites of transcription factors or other proteins can be targeted for mutation or deletion to study the role of the site, though they can also be targeted to change gene expression. Sites can be added through non-homologous end joining NHEJ or direct genome editing by homology directed repair (HDR). Increased use of genome sequencing, RNA expression and genome-wide studies of transcription factor binding have increased our ability to identify how the sites lead to developmental or temporal gene regulation. These control systems can be direct or can involve extensive cooperative regulation that can require the integration of activities from multiple enhancers. Transcription factors typically bind 6-12 bp-long degenerate DNA sequences. The low level of specificity provided by individual sites suggests that complex interactions and rules are involved in binding and the functional outcome. Binding sites with less degeneracy can provide simpler means of regulation. Artificial transcription factors can be designed to specify longer sequences that have less similar sequences in the genome and have lower potential for off-target cleavage. Any of these types of binding sites can be mutated, deleted or even created to enable changes in gene regulation or expression (Canver, M. C. et al., *Nature* (2015)).

Another class of gene regulatory regions having these features is microRNA (miRNA) binding sites. miRNAs are non-coding RNAs that play key roles in post-transcriptional gene regulation. miRNA can regulate the expression of 30% of all mammalian protein-encoding genes. Specific and potent gene silencing by double stranded RNA (RNAi) was discovered, plus additional small noncoding RNA (Canver, M. C. et al., *Nature* (2015)). The largest class of non-coding RNAs important for gene silencing is miRNAs. In mammals, miRNAs are first transcribed as a long RNA transcript, which can be separate transcriptional units, part of protein introns, or other transcripts. The long transcripts are called primary miRNA (pri-miRNA) that include imperfectly base-paired hairpin structures. These pri-miRNA can be cleaved into one or more shorter precursor miRNAs (pre-miRNAs) by Microprocessor, a protein complex in the nucleus, involving Drosha.

Pre-miRNAs are short stem loops ~70 nucleotides in length with a 2-nucleotide 3'-overhang that are exported, into the mature 19-25 nucleotide miRNA:miRNA* duplexes. The miRNA strand with lower base pairing stability (the guide strand) can be loaded onto the RNA-induced silencing complex (RISC). The passenger strand (marked with *), can be functional, but is usually degraded. The mature miRNA tethers RISC to partly complementary sequence motifs in target mRNAs predominantly found within the 3' untranslated regions (UTRs) and induces posttranscriptional gene silencing (Bartel, D. P. *Cell* 136, 215-233 (2009); Saj, A. & Lai, E. C. *Curr Opin Genet Dev* 21, 504-510 (2011)).

miRNAs can be important in development, differentiation, cell cycle and growth control, and in virtually all biological pathways in mammals and other multicellular organisms. miRNAs can also be involved in cell cycle control, apoptosis and stem cell differentiation, hematopoiesis, hypoxia, muscle development, neurogenesis, insulin secretion, cholesterol metabolism, aging, viral replication and immune responses.

A single miRNA can target hundreds of different mRNA transcripts, while an individual miRNA transcript can be targeted by many different miRNAs. More than 28645 microRNAs have been annotated in the latest release of miRBase (v.21). Some miRNAs can be encoded by multiple loci, some of which can be expressed from tandemly co-transcribed clusters. The features allow for complex regulatory networks with multiple pathways and feedback controls. miRNAs can be integral parts of these feedback and regulatory circuits and can help regulate gene expression by keeping protein production within limits (Herranz, H. & Cohen, S. M. *Genes Dev* 24, 1339-1344 (2010); Posadas, D. M. & Carthew, R. W. *Curr Opin Genet Dev* 27, 1-6 (2014)).

miRNA can also be important in a large number of human diseases that are associated with abnormal miRNA expression. This association underscores the importance of the miRNA regulatory pathway. Recent miRNA deletion studies have linked miRNA with regulation of the immune responses (Stern-Ginossar, N. et al., *Science* 317, 376-381 (2007)).

miRNA also has a strong link to cancer and can play a role in different types of cancer. miRNAs have been found to be downregulated in a number of tumors. miRNA can be important in the regulation of key cancer-related pathways, such as cell cycle control and the DNA damage response, and can therefore be used in diagnosis and can be targeted clinically. MicroRNAs can delicately regulate the balance of angiogenesis, such that experiments depleting all microRNAs suppress tumor angiogenesis (Chen, S. et al., *Genes Dev* 28, 1054-1067 (2014)).

As has been shown for protein coding genes, miRNA genes can also be subject to epigenetic changes occurring with cancer. Many miRNA loci can be associated with CpG islands increasing their opportunity for regulation by DNA methylation (Weber, B., Stresemann, C., Brueckner, B. & Lyko, F. *Cell Cycle* 6, 1001-1005 (2007)). The majority of studies have used treatment with chromatin remodeling drugs to reveal epigenetically silenced miRNAs.

In addition to their role in RNA silencing, miRNA can also activate translation (Posadas, D. M. & Carthew, R. W. *Curr Opin Genet Dev* 27, 1-6 (2014)). Knocking out miRNA sites may lead to decreased expression of the targeted gene, while introducing these sites may increase expression.

Individual miRNA can be knocked out most effectively by mutating the seed sequence (bases 2-8 of the microRNA), which can be important for binding specificity. Cleavage in this region, followed by mis-repair by NHEJ can effectively abolish miRNA function by blocking binding to target sites. miRNA could also be inhibited by specific targeting of the special loop region adjacent to the palindromic sequence. Catalytically inactive Cas9 can also be used to inhibit shRNA expression (Zhao, Y. et al., *Sci Rep* 4, 3943 (2014)). In addition to targeting the miRNA, the binding sites can also be targeted and mutated to prevent the silencing by miRNA.

According to the present disclosure, any of the microRNA (miRNA) or their binding sites may be incorporated into the compositions of the invention.

The compositions may have a region such as, but not limited to, a region comprising the sequence of any of the microRNAs listed in SEQ ID NOs: 632-4715, the reverse complement of the microRNAs listed in SEQ ID NOs: 632-4715 or the microRNA anti-seed region of any of the microRNAs listed in SEQ ID NOs: 632-4715.

The compositions of the present disclosure may comprise one or more microRNA target sequences, microRNA sequences, or microRNA seeds. Such sequences may correspond to any known microRNA such as those taught in U.S. Publication US2005/0261218 and U.S. Publication US2005/0059005. As a non-limiting example, known microRNAs, their sequences and their binding site sequences in the human genome are listed below in SEQ ID NOs: 632-4715.

A microRNA sequence comprises a "seed" sequence, i.e., a sequence in the region of positions 2-8 of the mature microRNA, which sequence has perfect Watson-Crick complementarity to the miRNA target sequence. A microRNA seed may comprise positions 2-8 or 2-7 of the mature microRNA. In some aspects, a microRNA seed may comprise 7 nucleotides (e.g., nucleotides 2-8 of the mature microRNA), wherein the seed-complementary site in the corresponding miRNA target is flanked by an adenine (A) opposed to microRNA position 1. In some aspects, a microRNA seed may comprise 6 nucleotides (e.g., nucleotides 2-7 of the mature microRNA), wherein the seed-complementary site in the corresponding miRNA target is flanked by an adenine (A) opposed to microRNA position 1. See for example, Grimson A, Farh K K, Johnston W K, Garrett-Engele P, Lim L P, Bartel D P; Mol Cell. 2007 Jul. 6; 27(1):91-105. The bases of the microRNA seed have complete complementarity with the target sequence.

Identification of microRNA, microRNA target regions, and their expression patterns and role in biology have been reported (Bonauer et al., Curr Drug Targets 2010 11:943-949; Anand and Cheresh Curr Opin Hematol 2011 18:171-176; Contreras and Rao Leukemia 2012 26:404-413 (2011 Dec. 20. doi: 10.1038/leu.2011.356); Bartel Cell 2009 136: 215-233; Landgraf et al, Cell, 2007 129:1401-1414; Gentner and Naldini, Tissue Antigens. 2012 80:393-403).

For example, if the composition is not intended to be delivered to the liver but ends up there, then miR-122, a microRNA abundant in liver, can inhibit the expression of the sequence delivered if one or multiple target sites of miR-122 are engineered into the polynucleotide encoding that target sequence. Introduction of one or multiple binding sites for different microRNA can be engineered to further decrease the longevity, stability, and protein translation hence providing an additional layer of tenability.

As used herein, the term "microRNA site" refers to a microRNA target site or a microRNA recognition site, or any nucleotide sequence to which a microRNA binds or associates. It should be understood that "binding" may follow traditional Watson-Crick hybridization rules or may reflect any stable association of the microRNA with the target sequence at or adjacent to the microRNA site.

Conversely, for the purposes of the compositions of the present disclosure, microRNA binding sites can be engineered out of (i.e. removed from) sequences in which they naturally occur in order to increase protein expression in specific tissues.

Specifically, microRNAs are known to be differentially expressed in immune cells (also called hematopoietic cells), such as antigen presenting cells (APCs) (e.g. dendritic cells and macrophages), macrophages, monocytes, B lymphocytes, T lymphocytes, granulocytes, natural killer cells, etc. Immune cell specific microRNAs are involved in immunogenicity, autoimmunity, the immune-response to infection, inflammation, as well as unwanted immune response after gene therapy and tissue/organ transplantation. Immune cells specific microRNAs also regulate many aspects of development, proliferation, differentiation and apoptosis of hematopoietic cells (immune cells). For example, miR-142 and miR-146 are exclusively expressed in the immune cells, particularly abundant in myeloid dendritic cells. Introducing the miR-142 binding site into the 3'-UTR of a polypeptide of the present disclosure can selectively suppress the gene expression in the antigen presenting cells through miR-142 mediated mRNA degradation, limiting antigen presentation in professional APCs (e.g. dendritic cells) and thereby preventing antigen-mediated immune response after gene delivery (see, Annoni A et al., blood, 2009, 114, 5152-5161).

In one example, microRNAs binding sites that are known to be expressed in immune cells, in particular, the antigen presenting cells, can be engineered into the polynucleotides to suppress the expression of the polynucleotide in APCs through microRNA mediated RNA degradation, subduing the antigen-mediated immune response, while the expression of the polynucleotide is maintained in non-immune cells where the immune cell specific microRNAs are not expressed.

Many microRNA expression studies have been conducted, and are described in the art, to profile the differential expression of microRNAs in various cancer cells/tissues and other diseases. Some microRNAs are abnormally overexpressed in certain cancer cells and others are underexpressed. For example, microRNAs are differentially expressed in cancer cells (WO2008/154098, US2013/0059015, US2013/0042333, WO2011/157294); cancer stem cells (US2012/0053224); pancreatic cancers and diseases (US2009/0131348, US2011/0171646, US2010/0286232, U.S. Pat. No. 8,389,210); asthma and inflammation (U.S. Pat. No. 8,415,096); prostate cancer (US2013/0053264); hepatocellular carcinoma (WO2012/151212, US2012/0329672, WO2008/054828, U.S. Pat. No. 8,252,538); lung cancer cells (WO2011/076143, WO2013/033640, WO2009/070653, US2010/0323357); cutaneous T-cell lymphoma (WO2013/011378); colorectal cancer cells (WO2011/0281756, WO2011/076142); cancer positive lymph nodes (WO2009/100430, US2009/0263803); nasopharyngeal carcinoma (EP2112235); chronic obstructive pulmonary disease (US2012/0264626, US2013/0053263); thyroid cancer (WO2013/066678); ovarian cancer cells (US2012/0309645, WO2011/095623); breast cancer cells (WO2008/154098, WO2007/081740, US2012/0214699), leukemia and lymphoma (WO2008/073915, US2009/0092974, US2012/0316081, US2012/0283310, WO2010/018563).

Non-limiting examples of microRNA sequences and the targeted tissues and/or cells are disclosed in SEQ ID NOs: 632-4715.

Genome Engineering Strategies

In some aspects, the methods of the present disclosure can involve editing one or both alleles. Gene editing to modify the allele(s) has the advantage of permanently altering the target gene or gene products.

A step of the ex vivo methods of the present disclosure can comprise editing the cells of the peripheral nervous system (e.g., a neuron or a glial cell such as Schwann cell in nerves or satellite glial cell in ganglia) isolated from the patient using genome engineering. Alternatively, a step of the ex vivo methods of the present disclosure can comprise editing the patient specific iPSC or mesenchymal stem cell. Likewise, a step of the in vivo methods of the present disclosure involves editing the cells in patients experiencing pain using genome engineering. Similarly, a step in the cellular methods of the present disclosure can comprise editing the SCN9A gene in a human cell by genome engineering.

Patients experiencing pain may exhibit a wide range of mutations in the SCN9A gene. Therefore, different patients may require different editing strategies. Any CRISPR endonuclease may be used in the methods of the present disclosure, each CRISPR endonuclease having its own associated PAM, which may or may not be disease specific.

For example, expression of the SCN9A gene may be disrupted or eliminated by introducing random insertions or deletions (indels) that arise due to the imprecise NHEJ repair pathway. The target regions may be the coding sequences of the SCN9A gene (i.e., exons). Inserting or deleting nucleotides into the coding sequence of a gene may cause a "frame shift" where the normal 3-letter codon pattern is disturbed. In this way, gene expression and therefore protein production can be reduced or eliminated. This approach may also be used to target any intron, intron:exon junction, or regulatory DNA element of the SCN9A gene where sequence alteration may interfere with the expression of the SCN9A gene.

As another example, NHEJ can also be used to delete segments of the gene, either directly or by altering splice donor or acceptor sites through cleavage by one gRNA targeting several locations, or several gRNAs. This can be useful if small random indels are inefficient to knock-out the target gene. Pairs of gRNAs have been used for this type of deletions.

Without a donor present, the ends from a DNA break or ends from different breaks can be joined using the several non-homologous repair pathways in which the DNA ends are joined with little or no base-pairing at the junction. In addition to canonical NHEJ, there are similar repair mechanisms, such as alt-NHEJ. If there are two breaks, the intervening segment can be deleted or inverted. NHEJ repair pathways can lead to insertions, deletions or mutations at the joints.

NHEJ can also lead to homology-independent target integration. For example, inclusion of a nuclease target site on a donor plasmid can promote integration of a transgene into the chromosomal double-strand break following in vivo nuclease cleavage of both the donor and the chromosome (Cristea., Biotechnol Bioeng. 2013 March; 110(3):871-80). NHEJ was used to insert a 15-kb inducible gene expression cassette into a defined locus in human cell lines after nuclease cleavage. (See e.g., Maresca, M., Lin, V. G., Guo, N. & Yang, Y., *Genome Res* 23, 539-546 (2013); Suzuki et al. *Nature,* 540, 144-149 (2016)). The integrated sequence may disrupt the reading frame of the SCN9A gene or alter the structure of the gene.

As a further alternative, homology directed repair (HDR) can also be used to knock-out a gene or alter the gene function. For example, the HDR knock-out strategy can involve disrupting the structure or function of the SCN9A gene by inserting into the SCN9A gene a non-functional or irrelevant sequence. This can be achieved by inducing one single stranded break or double stranded break in the gene of interest with one or more CRISPR endonucleases and a gRNA (e.g., crRNA+tracrRNA, or sgRNA), or two or more single stranded breaks or double stranded breaks in the gene of interest with one or more CRISPR endonucleases and two or more gRNAs, in the presence of a donor DNA template introduced exogenously to direct the cellular DSB response to Homology-Directed Repair (the donor DNA template can be a short single stranded oligonucleotide, a short double stranded oligonucleotide, a long single or double stranded DNA molecule). This approach can require development and optimization of gRNAs and donor DNA molecules for the SCN9A gene.

Homology directed repair (HDR) is essentially an error-free mechanism that uses a supplied homologous DNA sequence as a template during DSB repair. The rate of HDR is a function of the distance between the mutation and the cut site so choosing overlapping or nearest target sites is important. Templates can include extra sequences flanked by the homologous regions or can contain a sequence that differs from the genomic sequence, thus allowing sequence editing.

The most common form of HDR is homologous recombination. There are additional pathways for HDR, including single-strand annealing and alternative-HDR. Genome engineering tools allow researchers to manipulate the cellular homologous recombination pathways to create site-specific modifications to the genome. It has been found that cells can repair a double-stranded break using a synthetic donor molecule provided in trans. Therefore, by introducing a double-stranded break near a specific mutation and providing a suitable donor, targeted changes can be made in the genome. Specific cleavage increases the rate of HDR more than 1,000 fold above the rate of 1 in $10^6$ cells receiving a homologous donor alone. The rate of homology directed repair (HDR) at a particular nucleotide is a function of the distance to the cut site, so choosing overlapping or nearest target sites is important. Gene editing offers the advantage over gene addition, as editing in situ leaves the rest of the genome unperturbed.

Supplied donors for editing by HDR vary markedly but can contain the intended sequence with small or large flanking homology arms to allow annealing to the genomic DNA. The homology regions flanking the introduced genetic changes can be 30 bp or smaller, or as large as a multi-kilobase cassette that can contain promoters, cDNAs, etc. Both single-stranded and double-stranded oligonucleotide donors have been used. These oligonucleotides range in size from less than 100 nt to over many kb, though longer ssDNA can also be generated and used. Double-stranded donors can be used, including PCR amplicons, plasmids, and mini-circles. In general, it has been found that an AAV vector can be a very effective means of delivery of a donor template, though the packaging limits for individual donors is <5 kb. Active transcription of the donor increased HDR three-fold, indicating the inclusion of promoter may increase conversion. Conversely, CpG methylation of the donor decreased gene expression and HDR.

In addition to wild-type endonucleases, such as Cas9, nickase variants exist that have one or the other nuclease domain inactivated resulting in cutting of only one DNA strand. HDR can be directed from individual Cas nickases or using pairs of nickases that flank the target area. Donors can be single-stranded, nicked, or dsDNA.

The donor DNA can be supplied with the nuclease or independently by a variety of different methods, for example by transfection, nano-particle, micro-injection, or viral transduction. A range of tethering options has been proposed to increase the availability of the donors for HDR. Examples include attaching the donor to the nuclease, attaching to DNA binding proteins that bind nearby, or attaching to proteins that are involved in DNA end binding or repair.

The repair pathway choice can be guided by a number of culture conditions, such as those that influence cell cycling, or by targeting of DNA repair and associated proteins. For example, to increase HDR, key NHEJ molecules can be suppressed, such as KU70, KU80 or DNA ligase IV.

In addition to genome editing by NHEJ or HDR, site-specific gene insertions have been conducted that use both the NHEJ pathway and HDR. A combination approach may be applicable in certain settings, possibly including intron/exon borders. NHEJ may prove effective for ligation in the intron, while the error-free HDR may be better suited in the coding region.

The SCN9A gene contains a number of exons as shown in Table 3. Any one or more of these exons or nearby introns can be targeted in order to create one or more indels that disrupt the reading frame and eventually eliminate the abnormal SCN9A protein activity.

In some aspects, the methods can provide gRNA pairs that make a deletion by cutting the gene twice at locations flanking an unwanted sequence. This sequence may include one or more exons, introns, intron:exon junctions, other DNA sequences encoding regulatory elements of the SCN9A gene or combinations thereof. The cutting can be accomplished by a pair of DNA endonucleases that each makes a DSB in the genome, or by multiple nickases that together make a DSB in the genome.

Alternatively, the methods can provide one gRNA to make one double-strand cut within a coding or splicing sequence. The double-strand cut can be made by a single DNA endonuclease or multiple nickases that together make a DSB in the genome.

Splicing donor and acceptors are generally within 100 base pairs of the neighboring intron. In some examples, methods can provide gRNAs that cut approximately +/−100-3100 bp with respect to each exon/intron junction of interest.

For any of the genome editing strategies, gene editing can be confirmed by sequencing or PCR analysis.

Target Sequence Selection

Shifts in the location of the 5' boundary and/or the 3' boundary relative to particular reference loci can be used to facilitate or enhance particular applications of gene editing, which depend in part on the endonuclease system selected for the editing, as further described and illustrated herein.

In a first non-limiting example of such target sequence selection, many endonuclease systems have rules or criteria that can guide the initial selection of potential target sites for cleavage, such as the requirement of a PAM sequence motif in a particular position adjacent to the DNA cleavage sites in the case of CRISPR Type II or Type V endonucleases.

In another non-limiting example of target sequence selection or optimization, the frequency of off-target activity for a particular combination of target sequence and gene editing endonuclease (i.e. the frequency of DSBs occurring at sites other than the selected target sequence) can be assessed relative to the frequency of on-target activity. In some cases, cells that have been correctly edited at the desired locus can have a selective advantage relative to other cells. Illustrative, but non-limiting, examples of a selective advantage include the acquisition of attributes such as enhanced rates of replication, persistence, resistance to certain conditions, enhanced rates of successful engraftment or persistence in vivo following introduction into a patient, and other attributes associated with the maintenance or increased numbers or viability of such cells. In other cases, cells that have been correctly edited at the desired locus can be positively selected for by one or more screening methods used to identify, sort or otherwise select for cells that have been correctly edited. Both selective advantage and directed selection methods can take advantage of the phenotype associated with the alteration. In some cases, cells can be edited two or more times in order to create a second modification that creates a new phenotype that is used to select or purify the intended population of cells. Such a second modification could be created by adding a second gRNA enabling expression of a selectable or screenable marker. In some cases, cells can be correctly edited at the desired locus using a DNA fragment that contains the cDNA and also a selectable marker.

Whether any selective advantage is applicable or any directed selection is to be applied in a particular case, target sequence selection can also be guided by consideration of off-target frequencies in order to enhance the effectiveness of the application and/or reduce the potential for undesired alterations at sites other than the desired target. As described further and illustrated herein and in the art, the occurrence of off-target activity can be influenced by a number of factors including similarities and dissimilarities between the target site and various off-target sites, as well as the particular endonuclease used. Bioinformatics tools are available that assist in the prediction of off-target activity, and frequently such tools can also be used to identify the most likely sites of off-target activity, which can then be assessed in experimental settings to evaluate relative frequencies of off-target to on-target activity, thereby allowing the selection of sequences that have higher relative on-target activities. Illustrative examples of such techniques are provided herein, and others are known in the art.

Another aspect of target sequence selection relates to homologous recombination events. Sequences sharing regions of homology can serve as focal points for homologous recombination events that result in deletion of intervening sequences. Such recombination events occur during the normal course of replication of chromosomes and other DNA sequences, and also at other times when DNA sequences are being synthesized, such as in the case of repairs of double-strand breaks (DSBs), which occur on a regular basis during the normal cell replication cycle but can also be enhanced by the occurrence of various events (such as UV light and other inducers of DNA breakage) or the presence of certain agents (such as various chemical inducers). Many such inducers cause DSBs to occur indiscriminately in the genome, and DSBs can be regularly induced and repaired in normal cells. During repair, the original sequence can be reconstructed with complete fidelity, however, in some cases, small insertions or deletions (referred to as "indels") are introduced at the DSB site.

DSBs can also be specifically induced at particular locations, as in the case of the endonucleases systems described herein, which can be used to cause directed or preferential gene modification events at selected chromosomal locations. The tendency for homologous sequences to be subject to recombination in the context of DNA repair (as well as replication) can be taken advantage of in a number of circumstances, and is the basis for one application of gene editing systems, such as CRISPR, in which homology directed repair is used to insert a sequence of interest, provided through use of a "donor" polynucleotide, into a desired chromosomal location.

Regions of homology between particular sequences, which can be small regions of "microhomology" that can comprise as few as ten base pairs or less, can also be used to bring about desired deletions. For example, a single DSB can be introduced at a site that exhibits microhomology with a nearby sequence. During the normal course of repair of such DSB, a result that occurs with high frequency is the deletion of the intervening sequence as a result of recombination being facilitated by the DSB and concomitant cellular repair process.

In some circumstances, however, selecting target sequences within regions of homology can also give rise to much larger deletions, including gene fusions (when the deletions are in coding regions), which may or may not be desired given the particular circumstances.

The examples provided herein further illustrate the selection of various target regions for the creation of DSBs designed to induce insertions, deletions or mutations that result in reduction or elimination of SCN9A protein activity, as well as the selection of specific target sequences within such regions that are designed to minimize off-target events relative to on-target events.

Human Cells

For ameliorating pain or any disorder associated with SCN9A, as described and illustrated herein, the principal targets for gene editing are human cells. For example, in the ex vivo methods, the human cells can be somatic cells, which after being modified using the techniques as described, can give rise to differentiated cells, e.g., neurons of the peripheral nervous system or progenitor cells. For example, in the in vivo methods, the human cells may be neurons of the peripheral nervous system, or cells from other affected organs.

By performing gene editing in autologous cells that are derived from and therefore already completely matched with the patient in need, it is possible to generate cells that can be safely re-introduced into the patient, and effectively give rise to a population of cells that will be effective in ameliorating one or more clinical conditions associated with the patient's disease.

Stem cells are capable of both proliferation and giving rise to more progenitor cells, these in turn having the ability to generate a large number of mother cells that can in turn give rise to differentiated or differentiable daughter cells. The daughter cells themselves can be induced to proliferate and produce progeny that subsequently differentiate into one or more mature cell types, while also retaining one or more cells with parental developmental potential. The term "stem cell" refers then, to a cell with the capacity or potential, under particular circumstances, to differentiate to a more specialized or differentiated phenotype, and which retains the capacity, under certain circumstances, to proliferate without substantially differentiating. In one aspect, the term progenitor or stem cell refers to a generalized mother cell whose descendants (progeny) specialize, often in different directions, by differentiation, e.g., by acquiring completely individual characters, as occurs in progressive diversification of embryonic cells and tissues. Cellular differentiation is a complex process typically occurring through many cell divisions. A differentiated cell may derive from a multipotent cell that, itself, is derived from a multipotent cell, and so on. While each of these multipotent cells may be considered stem cells, the range of cell types that each can give rise to may vary considerably. Some differentiated cells also have the capacity to give rise to cells of greater developmental potential. Such capacity may be natural or may be induced artificially upon treatment with various factors. In many biological instances, stem cells can also be "multipotent" because they can produce progeny of more than one distinct cell type, but this is not required for "stem-ness."

Self-renewal can be another important aspect of the stem cell. In theory, self-renewal can occur by either of two major mechanisms. Stem cells can divide asymmetrically, with one daughter retaining the stem state and the other daughter expressing some distinct other specific function and phenotype. Alternatively, some of the stem cells in a population can divide symmetrically into two stems, thus maintaining some stem cells in the population as a whole, while other cells in the population give rise to differentiated progeny only. Generally, "progenitor cells" have a cellular phenotype that is more primitive (i.e., is at an earlier step along a developmental pathway or progression than is a fully differentiated cell). Often, progenitor cells also have significant or very high-proliferative potential. Progenitor cells can give rise to multiple distinct differentiated cell types or to a single differentiated cell type, depending on the developmental pathway and on the environment in which the cells develop and differentiate.

In the context of cell ontogeny, the adjective "differentiated," or "differentiating" is a relative term. A "differentiated cell" is a cell that has progressed further down the developmental pathway than the cell to which it is being compared. Thus, stem cells can differentiate into lineage-restricted precursor cells (such as a myocyte progenitor cell), which in turn can differentiate into other types of precursor cells further down the pathway (such as a myocyte precursor), and then to an end-stage differentiated cell, such as a myocyte, which plays a characteristic role in a certain tissue type, and may or may not retain the capacity to proliferate further.

Induced Pluripotent Stem Cells

The genetically engineered human cells described herein can be induced pluripotent stem cells (iPSCs). An advantage of using iPSCs is that the cells can be derived from the same subject to which the progenitor cells are to be administered. That is, a somatic cell can be obtained from a subject, reprogrammed to an induced pluripotent stem cell, and then re-differentiated into a progenitor cell to be administered to the subject (e.g., autologous cells). Because the progenitors are essentially derived from an autologous source, the risk of engraftment rejection or allergic response can be reduced compared to the use of cells from another subject or group of subjects. In addition, the use of iPSCs negates the need for cells obtained from an embryonic source. Thus, in one aspect, the stem cells used in the disclosed methods are not embryonic stem cells.

Although differentiation is generally irreversible under physiological contexts, several methods have been recently developed to reprogram somatic cells to iPSCs. Exemplary methods are known to those of skill in the art and are described briefly herein below.

The term "reprogramming" refers to a process that alters or reverses the differentiation state of a differentiated cell (e.g., a somatic cell). Stated another way, reprogramming refers to a process of driving the differentiation of a cell backwards to a more undifferentiated or more primitive type of cell. It should be noted that placing many primary cells in culture can lead to some loss of fully differentiated characteristics. Thus, simply culturing such cells included in the term differentiated cells does not render these cells non-differentiated cells (e.g., undifferentiated cells) or pluripotent cells. The transition of a differentiated cell to pluripotency requires a reprogramming stimulus beyond the stimuli that lead to partial loss of differentiated character in culture. Reprogrammed cells also have the characteristic of the capacity of extended passaging without loss of growth potential, relative to primary cell parents, which generally have capacity for only a limited number of divisions in culture.

The cell to be reprogrammed can be either partially or terminally differentiated prior to reprogramming. Reprogramming can encompass complete reversion of the differentiation state of a differentiated cell (e.g., a somatic cell) to a pluripotent state or a multipotent state. Reprogramming can encompass complete or partial reversion of the differentiation state of a differentiated cell (e.g., a somatic cell) to an undifferentiated cell (e.g., an embryonic-like cell). Reprogramming can result in expression of particular genes by the cells, the expression of which further contributes to reprogramming. In certain examples described herein, reprogramming of a differentiated cell (e.g., a somatic cell) can cause the differentiated cell to assume an undifferentiated state (e.g., is an undifferentiated cell). The resulting cells are referred to as "reprogrammed cells," or "induced pluripotent stem cells (iPSCs or iPS cells)."

Reprogramming can involve alteration, e.g., reversal, of at least some of the heritable patterns of nucleic acid modification (e.g., methylation), chromatin condensation, epigenetic changes, genomic imprinting, etc., that occur during cellular differentiation. Reprogramming is distinct from simply maintaining the existing undifferentiated state of a cell that is already pluripotent or maintaining the existing less than fully differentiated state of a cell that is already a multipotent cell (e.g., a myogenic stem cell). Reprogramming is also distinct from promoting the self-renewal or proliferation of cells that are already pluripotent or multipotent, although the compositions and methods described herein can also be of use for such purposes, in some examples.

Many methods are known in the art that can be used to generate pluripotent stem cells from somatic cells. Any such method that reprograms a somatic cell to the pluripotent phenotype would be appropriate for use in the methods described herein.

Reprogramming methodologies for generating pluripotent cells using defined combinations of transcription factors have been described. Mouse somatic cells can be converted to ES cell-like cells with expanded developmental potential by the direct transduction of Oct4, Sox2, Klf4, and c-Myc; see, e.g., Takahashi and Yamanaka, Cell 126(4): 663-76 (2006). iPSCs resemble ES cells, as they restore the pluripotency-associated transcriptional circuitry and much of the epigenetic landscape. In addition, mouse iPSCs satisfy all the standard assays for pluripotency: specifically, in vitro differentiation into cell types of the three germ layers, teratoma formation, contribution to chimeras, germline transmission [see, e.g., Maherali and Hochedlinger, Cell Stem Cell. 3(6):595-605 (2008)], and tetraploid complementation.

Human iPSCs can be obtained using similar transduction methods, and the transcription factor trio, OCT4, SOX2, and NANOG, has been established as the core set of transcription factors that govern pluripotency; see, e.g., Budniatzky and Gepstein, Stem Cells Transl Med. 3(4):448-57 (2014); Barrett et al., Stem Cells Trans Med 3:1-6 sctm.2014-0121 (2014); Focosi et al., Blood Cancer Journal 4: e211 (2014); and references cited therein. The production of iPSCs can be achieved by the introduction of nucleic acid sequences encoding stem cell-associated genes into an adult, somatic cell, historically using viral vectors.

iPSCs can be generated or derived from terminally differentiated somatic cells, as well as from adult stem cells, or somatic stem cells. That is, a non-pluripotent progenitor cell can be rendered pluripotent or multipotent by reprogramming. In such instances, it may not be necessary to include as many reprogramming factors as required to reprogram a terminally differentiated cell. Further, reprogramming can be induced by the non-viral introduction of reprogramming factors, e.g., by introducing the proteins themselves, or by introducing nucleic acids that encode the reprogramming factors, or by introducing messenger RNAs that upon translation produce the reprogramming factors (see e.g., Warren et al., Cell Stem Cell, 7(5):618-30 (2010). Reprogramming can be achieved by introducing a combination of nucleic acids encoding stem cell-associated genes, including, for example, Oct-4 (also known as Oct-3/4 or Pouf51), Sox1, Sox2, Sox3, Sox 15, Sox 18, NANOG, Klf1, Klf2, Klf4, Klf5, NR5A2, c-Myc, 1-Myc, n-Myc, Rem2, Tert, and LIN28. Reprogramming using the methods and compositions described herein can further comprise introducing one or more of Oct-3/4, a member of the Sox family, a member of the Klf family, and a member of the Myc family to a somatic cell. The methods and compositions described herein can further comprise introducing one or more of each of Oct-4, Sox2, Nanog, c-MYC and Klf4 for reprogramming. As noted above, the exact method used for reprogramming is not necessarily critical to the methods and compositions described herein. However, where cells differentiated from the reprogrammed cells are to be used in, e.g., human therapy, in one aspect the reprogramming is not effected by a method that alters the genome. Thus, in such examples, reprogramming can be achieved, e.g., without the use of viral or plasmid vectors.

The efficiency of reprogramming (i.e., the number of reprogrammed cells) derived from a population of starting cells can be enhanced by the addition of various agents, e.g., small molecules, as shown by Shi et al., Cell-Stem Cell 2:525-528 (2008); Huangfu et al., Nature Biotechnology 26(7):795-797 (2008) and Marson et al., Cell-Stem Cell 3: 132-135 (2008). Thus, an agent or combination of agents that enhance the efficiency or rate of induced pluripotent stem cell production can be used in the production of patient-specific or disease-specific iPSCs. Some non-limiting examples of agents that enhance reprogramming efficiency include soluble Wnt, Wnt conditioned media, BIX-01294 (a G9a histone methyltransferase), PD0325901 (a MEK inhibitor), DNA methyltransferase inhibitors, histone deacetylase (HDAC) inhibitors, valproic acid, 5'-azacytidine, dexamethasone, suberoylanilide, hydroxamic acid (SAHA), vitamin C, and trichostatin (TSA), among others.

Other non-limiting examples of reprogramming enhancing agents include: Suberoylanilide Hydroxamic Acid (SAHA (e.g., MK0683, vorinostat) and other hydroxamic acids), BML-210, Depudecin (e.g., (−)-Depudecin), HC Toxin, Nullscript (4-(1,3-Dioxo-1H,3H-benzo[de]isoquinolin-2-yl)-N-hydroxybutanamide), Phenylbutyrate (e.g., sodium phenylbutyrate) and Valproic Acid ((VPA) and other short chain fatty acids), Scriptaid, Suramin Sodium, Trichostatin A (TSA), APHA Compound 8, Apicidin, Sodium Butyrate, pivaloyloxymethyl butyrate (Pivanex, AN-9), Trapoxin B, Chlamydocin, Depsipeptide (also known as FR901228 or FK228), benzamides (e.g., CI-994 (e.g., N-acetyl dinaline) and MS-27-275), MGCD0103, NVP-LAQ-824, CBHA (m-carboxycinnaminic acid bishydroxamic acid), JNJ16241199, Tubacin, A-161906, proxamide, oxamflatin, 3-Cl-UCHA (e.g., 6-(3-chlorophenylureido) caproic hydroxamic acid), AOE (2-amino-8-oxo-9,10-epoxydecanoic acid), CHAP31 and CHAP 50. Other reprogramming enhancing agents include, for example, dominant negative forms of the HDACs (e.g., catalytically inactive forms), siRNA inhibitors of the HDACs, and antibodies that specifically bind to the HDACs. Such inhibitors are available, e.g., from BIOMOL International, Fukasawa, Merck Biosciences, Novartis, Gloucester Pharmaceuticals, Titan Pharmaceuticals, MethylGene, and Sigma Aldrich.

To confirm the induction of pluripotent stem cells for use with the methods described herein, isolated clones can be tested for the expression of a stem cell marker. Such expression in a cell derived from a somatic cell identifies the cells as induced pluripotent stem cells. Stem cell markers can be selected from the non-limiting group including SSEA3, SSEA4, CD9, Nanog, Fbx15, Ecat1, Esg1, Eras, Gdf3, Fgf4, Cripto, Dax1, Zpf296, Slc2a3, Rex1, Utf1, and Nat1. In one case, for example, a cell that expresses Oct4 or Nanog is identified as pluripotent. Methods for detecting the expression of such markers can include, for example, RT-PCR and immunological methods that detect the presence of the encoded polypeptides, such as Western blots or flow cytometric analyses. Detection can involve not only RT-PCR, but can also include detection of protein markers. Intracellular markers may be best identified via RT-PCR, or protein detection methods such as immunocytochemistry, while cell surface markers are readily identified, e.g., by immunocytochemistry.

The pluripotent stem cell character of isolated cells can be confirmed by tests evaluating the ability of the iPSCs to differentiate into cells of each of the three germ layers. As one example, teratoma formation in nude mice can be used to evaluate the pluripotent character of the isolated clones. The cells can be introduced into nude mice and histology and/or immunohistochemistry can be performed on a tumor arising from the cells. The growth of a tumor comprising cells from all three germ layers, for example, further indicates that the cells are pluripotent stem cells.

Cells of the Peripheral Nervous System

In some aspects, the genetically engineered human cells described herein are neurons and nerves outside of the brain and spinal cord. Neurons, which process information, and glial cells, which provide mechanical and metabolic support to the nervous system, are the two main classes of cells of the peripheral nervous system. Non-limiting examples of neurons include sensory neurons (collect impulses from the sensory receptors in areas such as skin, muscles, and organs and carries those impulses through the nerves to the CNS) and motor neurons (collect outgoing messages from the CNS and delivers them to the appropriate body organs, instructing them what action needs to be taken). Non-limiting examples of glial cells include Schwann cells in nerves or satellite cells in ganglia.

Creating Patient Specific iPSCs

One step of the ex vivo methods of the present disclosure can involve creating a patient specific iPS cell, patient specific iPS cells, or a patient specific iPS cell line. There are many established methods in the art for creating patient specific iPS cells, as described in Takahashi and Yamanaka 2006; Takahashi, Tanabe et al. 2007. For example, the creating step can comprise: a) isolating a somatic cell, such as a skin cell or fibroblast, from the patient; and b) introducing a set of pluripotency-associated genes into the somatic cell in order to induce the cell to become a pluripotent stem cell. The set of pluripotency-associated genes can be one or more of the genes selected from the group consisting of OCT4, SOX1, SOX2, SOX3, SOX15, SOX18, NANOG, KLF1, KLF2, KLF4, KLF5, c-MYC, n-MYC, REM2, TERT and LIN28.

Performing a Biopsy or Aspirate of the Patient's Tissue

A biopsy or aspirate is a sample of tissue or fluid taken from the body. There are many different kinds of biopsies or aspirates. Nearly all of them involve using a sharp tool to remove a small amount of tissue. If the biopsy will be on the skin or other sensitive area, numbing medicine can be applied first. A biopsy or aspirate may be performed according to any of the known methods in the art. For example, in a bone marrow aspirate, a large needle is used to enter the pelvis bone to collect bone marrow. For example, in the case of a nerve biopsy from skin or leg to isolate neurons of the peripheral nervous system, the nerve segment is excised inflicting minimal mechanical injury. Squeezing or stretching the nerve is avoided and excessive removal of fat or connective tissue is not attempted.

Isolating a Neuron of the Peripheral Nervous System

Neurons of the peripheral nervous system may be isolated according to any known method in the art. For example, the nerve segment is excised inflicting minimal mechanical injury under aseptic conditions. Squeezing or stretching the nerve is strictly avoided and excessive removal of fat or connective tissue is not attempted. Since, nerve fibers are very sensitive to mechanical injury, the proximal nerve cut is performed first. Following the isolation, the outermost connective tissue layer, the epineurium, is removed and collected for enzymatic digestion. The fibers are teased with the help of fine forceps until all fascicles are separated into individual fibers. The epineurium and teased fibers are then subjected to enzymatic digestion overnight with dispase II and type I collagenase. The digested products are filtered and collected by centrifugation. The resulting cell suspensions are plated onto adhesive PLL/laminin substrate. The adherent cells are cultured for analysis (Andersen et al., Scientific Reports-Nature, 2016, 6:31781).

Isolating a Mesenchymal Stem Cell

Mesenchymal stem cells can be isolated according to any method known in the art, such as from a patient's bone marrow or peripheral blood. For example, marrow aspirate can be collected into a syringe with heparin. Cells can be washed and centrifuged on a Percoll. The cells can be cultured in Dulbecco's modified Eagle's medium (DMEM) (low glucose) containing 10% fetal bovine serum (FBS) (Pittinger M F, Mackay A M, Beck S C et al., Science 1999; 284:143-147).

Genetically Modified Cells

The term "genetically modified cell" refers to a cell that comprises at least one genetic modification introduced by genome editing (e.g., using the CRISPR/Cas9 or CRISPR/Cpf1 system). In some ex vivo examples herein, the genetically modified cell can be genetically modified progenitor cell. In some in vivo examples herein, the genetically modified cell can be a genetically modified neuron of the peripheral nervous system. A genetically modified cell comprising an exogenous genome-targeting nucleic acid and/or an exogenous nucleic acid encoding a genome-targeting nucleic acid is contemplated herein.

The term "control treated population" describes a population of cells that has been treated with identical media, viral induction, nucleic acid sequences, temperature, confluency, flask size, pH, etc., with the exception of the addition of the genome editing components. Any method known in the art can be used to measure transcription of SCN9A gene or protein expression or activity, for example Western Blot analysis of the SCN9A protein or real time PCR for quantifying SCN9A mRNA.

The term "isolated cell" refers to a cell that has been removed from an organism in which it was originally found, or a descendant of such a cell. Optionally, the cell can be cultured in vitro, e.g., under defined conditions or in the presence of other cells. Optionally, the cell can be later introduced into a second organism or re-introduced into the organism from which it (or the cell from which it is descended) was isolated.

The term "isolated population" with respect to an isolated population of cells refers to a population of cells that has been removed and separated from a mixed or heterogeneous population of cells. In some cases, the isolated population can be a substantially pure population of cells, as compared to the heterogeneous population from which the cells were isolated or enriched. In some cases, the isolated population can be an isolated population of human progenitor cells, e.g., a substantially pure population of human progenitor cells, as compared to a heterogeneous population of cells comprising human progenitor cells and cells from which the human progenitor cells were derived.

The term "substantially enhanced," with respect to a particular cell population, refers to a population of cells in which the occurrence of a particular type of cell is increased relative to pre-existing or reference levels, by at least 2-fold, at least 3-, at least 4-, at least 5-, at least 6-, at least 7-, at least 8-, at least 9, at least 10-, at least 20-, at least 50-, at least 100-, at least 400-, at least 1000-, at least 5000-, at least 20000-, at least 100000- or more fold depending, e.g., on the desired levels of such cells for ameliorating pain.

The term "substantially enriched" with respect to a particular cell population, refers to a population of cells that is at least about 10%, about 20%, about 30%, about 40%, about 50%, about 60%, about 70% or more with respect to the cells making up a total cell population.

The term "substantially pure" with respect to a particular cell population, refers to a population of cells that is at least about 75%, at least about 85%, at least about 90%, or at least about 95% pure, with respect to the cells making up a total cell population. That is, the terms "substantially pure" or "essentially purified," with regard to a population of progenitor cells, refers to a population of cells that contain fewer than about 20%, about 15%, about 10%, about 9%, about 8%, about 7%, about 6%, about 5%, about 4%, about 3%, about 2%, about 1%, or less than 1%, of cells that are not progenitor cells as defined by the terms herein.

Differentiation of Genome-Edited iPSCs into Cells of the Peripheral Nervous System Another step of the ex vivo methods of the present disclosure can comprise differentiating the genome-edited iPSCs into cells of the peripheral nervous system (e.g., a neuron or a glial cell such as Schwann cell in nerves or satellite glial cell in ganglia). The differentiating step may be performed according to any method known in the art. For example, neuronal differentiation of iPSCs is induced using a combination of brain-derived neurotrophic factor (BDNF), glial cell-derived neurotrophic factor (GDNF), nerve growth factor (NGF) and dibutyryl cyclic AMP (dbcAMP). Then, the iPSCs-derived neural cells are further differentiated into Schwann cells using ciliary neurotrophic factor (CNTF), neuregulin 1β and dbcAMP (Wang et al., Biomaterials. 2011; 32(22): 5023-5032).

Differentiation of Genome-Edited Mesenchymal Stem Cells into Cells of the Peripheral Nervous System Another step of the ex vivo methods of the present disclosure can comprise differentiating the genome-edited mesenchymal stem cells into cells of the peripheral nervous system (e.g., a neuron or a glial cell such as Schwann cell in nerves or satellite glial cell in ganglia). The differentiating step may be performed according to any method known in the art. For example, MSC are treated with various factors and hormones, including basic fibroblast growth factor, human recombinant platelet derived growth factor, forskolin, and glial growth factor-2 (Ladak et al., Experimental Neurology 228 (2011) 242-252).

Implanting Cells into Patients

Another step of the ex vivo methods of the present disclosure can comprise implanting the genome-edited neurons of the peripheral nervous system into patients. This implanting step may be accomplished using any method of implantation known in the art. For example, the genetically modified cells may be injected directly in the patient's blood or otherwise administered to the patient.

III. Formulations and Delivery

Pharmaceutically Acceptable Carriers

The ex vivo methods of administering progenitor cells to a subject contemplated herein involve the use of therapeutic compositions comprising progenitor cells.

Therapeutic compositions can contain a physiologically tolerable carrier together with the cell composition, and optionally at least one additional bioactive agent as described herein, dissolved or dispersed therein as an active ingredient. In some cases, the therapeutic composition is not substantially immunogenic when administered to a mammal or human patient for therapeutic purposes, unless so desired.

In general, the progenitor cells described herein can be administered as a suspension with a pharmaceutically acceptable carrier. One of skill in the art will recognize that a pharmaceutically acceptable carrier to be used in a cell composition will not include buffers, compounds, cryopreservation agents, preservatives, or other agents in amounts that substantially interfere with the viability of the cells to be delivered to the subject. A formulation comprising cells can include e.g., osmotic buffers that permit cell membrane integrity to be maintained, and optionally, nutrients to maintain cell viability or enhance engraftment upon administration. Such formulations and suspensions are known to those of skill in the art and/or can be adapted for use with the progenitor cells, as described herein, using routine experimentation.

A cell composition can also be emulsified or presented as a liposome composition, provided that the emulsification procedure does not adversely affect cell viability. The cells and any other active ingredient can be mixed with excipients that are pharmaceutically acceptable and compatible with the active ingredient, and in amounts suitable for use in the therapeutic methods described herein.

Additional agents included in a cell composition can include pharmaceutically acceptable salts of the components therein. Pharmaceutically acceptable salts include the acid addition salts (formed with the free amino groups of the polypeptide) that are formed with inorganic acids, such as, for example, hydrochloric or phosphoric acids, or such organic acids as acetic, tartaric, mandelic and the like. Salts formed with the free carboxyl groups can also be derived from inorganic bases, such as, for example, sodium, potassium, ammonium, calcium or ferric hydroxides, and such organic bases as isopropylamine, trimethylamine, 2-ethylamino ethanol, histidine, procaine and the like.

Physiologically tolerable carriers are well known in the art. Exemplary liquid carriers are sterile aqueous solutions that contain no materials in addition to the active ingredients and water, or contain a buffer such as sodium phosphate at physiological pH value, physiological saline or both, such as phosphate-buffered saline. Still further, aqueous carriers can contain more than one buffer salt, as well as salts such as sodium and potassium chlorides, dextrose, polyethylene glycol and other solutes. Liquid compositions can also contain liquid phases in addition to and to the exclusion of water. Exemplary of such additional liquid phases are glycerin, vegetable oils such as cottonseed oil, and water-oil emulsions. The amount of an active compound used in the cell compositions that is effective in the treatment of a particular disorder or condition can depend on the nature of the disorder or condition, and can be determined by standard clinical techniques.

Guide RNA Formulation

Guide RNAs of the present disclosure can be formulated with pharmaceutically acceptable excipients such as carriers, solvents, stabilizers, adjuvants, diluents, etc., depending upon the particular mode of administration and dosage form. Guide RNA compositions can be formulated to achieve a physiologically compatible pH, and range from a pH of about 3 to a pH of about 11, about pH 3 to about pH 7, depending on the formulation and route of administration. In some cases, the pH can be adjusted to a range from about pH 5.0 to about pH 8. In some cases, the compositions can comprise a therapeutically effective amount of at least one compound as described herein, together with one or more pharmaceutically acceptable excipients. Optionally, the compositions can comprise a combination of the compounds described herein, or can include a second active ingredient useful in the treatment or prevention of bacterial growth (for example and without limitation, anti-bacterial or anti-microbial agents), or can include a combination of reagents of the present disclosure.

Suitable excipients include, for example, carrier molecules that include large, slowly metabolized macromolecules such as proteins, polysaccharides, polylactic acids, polyglycolic acids, polymeric amino acids, amino acid copolymers, and inactive virus particles. Other exemplary excipients can include antioxidants (for example and without limitation, ascorbic acid), chelating agents (for example and without limitation, EDTA), carbohydrates (for example and without limitation, dextrin, hydroxyalkylcellulose, and hydroxyalkylmethylcellulose), stearic acid, liquids (for example and without limitation, oils, water, saline, glycerol and ethanol), wetting or emulsifying agents, pH buffering substances, and the like.

Delivery

Guide RNA polynucleotides (RNA or DNA) and/or endonuclease polynucleotide(s) (RNA or DNA) can be delivered by viral or non-viral delivery vehicles known in the art. Alternatively, endonuclease polypeptide(s) can be delivered by viral or non-viral delivery vehicles known in the art, such as electroporation or lipid nanoparticles. In further alternative aspects, the DNA endonuclease can be delivered as one or more polypeptides, either alone or pre-complexed with one or more guide RNAs, or one or more crRNA together with a tracrRNA.

Polynucleotides can be delivered by non-viral delivery vehicles including, but not limited to, nanoparticles, liposomes, ribonucleoproteins, positively charged peptides, small molecule RNA-conjugates, aptamer-RNA chimeras, and RNA-fusion protein complexes. Some exemplary non-viral delivery vehicles are described in Peer and Lieberman, Gene Therapy, 18: 1127-1133 (2011) (which focuses on non-viral delivery vehicles for siRNA that are also useful for delivery of other polynucleotides).

For polynucleotides of the present disclosure, the formulation may be selected from any of those taught, for example, in International Application PCT/US2012/069610.

Polynucleotides, such as guide RNA, sgRNA, and mRNA encoding an endonuclease, may be delivered to a cell or a patient by a lipid nanoparticle (LNP).

A LNP refers to any particle having a diameter of less than 1000 nm, 500 nm, 250 nm, 200 nm, 150 nm, 100 nm, 75 nm, 50 nm, or 25 nm. Alternatively, a nanoparticle may range in size from 1-1000 nm, 1-500 nm, 1-250 nm, 25-200 nm, 25-100 nm, 35-75 nm, or 25-60 nm.

LNPs may be made from cationic, anionic, or neutral lipids. Neutral lipids, such as the fusogenic phospholipid DOPE or the membrane component cholesterol, may be included in LNPs as 'helper lipids' to enhance transfection activity and nanoparticle stability. Limitations of cationic lipids include low efficacy owing to poor stability and rapid clearance, as well as the generation of inflammatory or anti-inflammatory responses.

LNPs may also be comprised of hydrophobic lipids, hydrophilic lipids, or both hydrophobic and hydrophilic lipids.

Any lipid or combination of lipids that are known in the art can be used to produce a LNP. Examples of lipids used to produce LNPs are: DOTMA, DOSPA, DOTAP, DMRIE, DC-cholesterol, DOTAP-cholesterol, GAP-DMORIE-DPyPE, and GL67A-DOPE-DMPE-polyethylene glycol (PEG). Examples of cationic lipids are: 98N12-5, C12-200, DLin-KC2-DMA (KC2), DLin-MC3-DMA (MC3), XTC, MD1, and 7C1. Examples of neutral lipids are: DPSC, DPPC, POPC, DOPE, and SM. Examples of PEG-modified lipids are: PEG-DMG, PEG-CerC14, and PEG-CerC20.

The lipids can be combined in any number of molar ratios to produce a LNP. In addition, the polynucleotide(s) can be combined with lipid(s) in a wide range of molar ratios to produce a LNP.

As stated previously, the site-directed polypeptide and genome-targeting nucleic acid can each be administered separately to a cell or a patient. On the other hand, the site-directed polypeptide can be pre-complexed with one or more guide RNAs, or one or more crRNA together with a tracrRNA. The pre-complexed material can then be administered to a cell or a patient. Such pre-complexed material is known as a ribonucleoprotein particle (RNP).

RNA is capable of forming specific interactions with RNA or DNA. While this property is exploited in many biological processes, it also comes with the risk of promiscuous interactions in a nucleic acid-rich cellular environment. One solution to this problem is the formation of ribonucleoprotein particles (RNPs), in which the RNA is pre-complexed with an endonuclease. Another benefit of the RNP is protection of the RNA from degradation.

The endonuclease in the RNP can be modified or unmodified. Likewise, the gRNA, crRNA, tracrRNA, or sgRNA can be modified or unmodified. Numerous modifications are known in the art and can be used.

The endonuclease and sgRNA can be generally combined in a 1:1 molar ratio. Alternatively, the endonuclease, crRNA and tracrRNA can be generally combined in a 1:1:1 molar ratio. However, a wide range of molar ratios can be used to produce a RNP.

AAV (Adeno Associated Virus)

A recombinant adeno-associated virus (AAV) vector can be used for delivery. Techniques to produce rAAV particles, in which an AAV genome to be packaged that includes the polynucleotide to be delivered, rep and cap genes, and helper virus functions are provided to a cell are standard in the art. Production of rAAV typically requires that the following components are present within a single cell (denoted herein as a packaging cell): a rAAV genome, AAV rep and cap genes separate from (i.e., not in) the rAAV genome, and helper virus functions. The AAV rep and cap genes may be from any AAV serotype for which recombinant virus can be derived, and may be from a different AAV serotype than the rAAV genome ITRs, including, but not limited to, AAV serotypes described herein. Production of pseudotyped rAAV is disclosed in, for example, international patent application publication number WO 01/83692.

AAV Serotypes

AAV particles packaging polynucleotides encoding compositions of the present disclosure, e.g., endonucleases, donor sequences, or RNA guide molecules, of the present disclosure may comprise or be derived from any natural or recombinant AAV serotype. According to the present disclosure, the AAV particles may utilize or be based on a serotype selected from any of the following serotypes, and variants thereof including but not limited to AAV1, AAV10, AAV106.1/hu.37, AAV11, AAV114.3/hu.40, AAV12, AAV127.2/hu.41, AAV127.5/hu.42, AAV128.1/hu.43, AAV128.3/hu.44, AAV130.4/hu.48, AAV145.1/hu.53, AAV145.5/hu.54, AAV145.6/hu.55, AAV16.12/hu.11, AAV16.3, AAV16.8/hu.10, AAV161.10/hu.60, AAV161.6/hu.61, AAV1-7/rh.48, AAV1-8/rh.49, AAV2, AAV2.5T, AAV2-15/rh.62, AAV223.1, AAV223.2, AAV223.4, AAV223.5, AAV223.6, AAV223.7, AAV2-3/rh.61, AAV24.1, AAV2-4/rh.50, AAV2-5/rh.51, AAV27.3, AAV29.3/bb.1, AAV29.5/bb.2, AAV2G9, AAV-2-pre-miRNA-101, AAV3, AAV3.1/hu.6, AAV3.1/hu.9, AAV3-11/rh.53, AAV3-3, AAV33.12/hu.17, AAV33.4/hu.15, AAV33.8/hu.16, AAV3-9/rh.52, AAV3a, AAV3b, AAV4, AAV4-19/rh.55, AAV42.12, AAV42-10, AAV42-11, AAV42-12, AAV42-13, AAV42-15, AAV42-1b, AAV42-2, AAV42-3a, AAV42-3b, AAV42-4, AAV42-5a, AAV42-5b, AAV42-6b, AAV42-8, AAV42-aa, AAV43-1, AAV43-12, AAV43-20, AAV43-21, AAV43-23, AAV43-25, AAV43-5, AAV4-4, AAV44.1, AAV44.2, AAV44.5, AAV46.2/hu.28, AAV46.6/hu.29, AAV4-8/r11.64, AAV4-8/rh.64, AAV4-9/rh.54, AAV5, AAV52.1/hu.20, AAV52/hu.19, AAV5-22/rh.58, AAV5-3/rh.57, AAV54.1/hu.21, AAV54.2/hu.22, AAV54.4R/hu.27, AAV54.5/hu.23, AAV54.7/hu.24, AAV58.2/hu.25, AAV6, AAV6.1, AAV6.1.2, AAV6.2, AAV7, AAV7.2, AAV7.3/hu.7, AAV8, AAV-8b, AAV-8h, AAV9, AAV9.11, AAV9.13, AAV9.16, AAV9.24, AAV9.45, AAV9.47, AAV9.61, AAV9.68, AAV9.84, AAV9.9, AAVA3.3, AAVA3.4, AAVA3.5, AAVA3.7, AAV-b, AAVC1, AAVC2, AAVC5, AAVCh.5, AAVCh.5R1, AAVcy.2, AAVcy.3, AAVcy.4, AAVcy.5, AAVCy.5R1, AAVCy.5R2, AAVCy.5R3, AAVCy.5R4, AAVcy.6, AAV-DJ, AAV-DJ8, AAVF3, AAVF5, AAV-h, AAVH-1/hu.1, AAVH2, AAVH-5/hu.3, AAVH6, AAVhE1.1, AAVhER1.14, AAVhEr1.16, AAVhEr1.18, AAVhER1.23, AAVhEr1.35, AAVhEr1.36, AAVhEr1.5, AAVhEr1.7, AAVhEr1.8, AAVhEr2.16, AAVhEr2.29, AAVhEr2.30, AAVhEr2.31, AAVhEr2.36, AAVhEr2.4, AAVhEr3.1, AAVhu.1, AAVhu.10, AAVhu.11, AAVhu.11, AAVhu.12, AAVhu.13, AAVhu.14/9, AAVhu.15, AAVhu.16, AAVhu.17, AAVhu.18, AAVhu.19, AAVhu.2, AAVhu.20, AAVhu.21, AAVhu.22, AAVhu.23.2, AAVhu.24, AAVhu.25, AAVhu.27, AAVhu.28, AAVhu.29, AAVhu.29R, AAVhu.3, AAVhu.31, AAVhu.32, AAVhu.34, AAVhu.35, AAVhu.37, AAVhu.39, AAVhu.4, AAVhu.40, AAVhu.41, AAVhu.42, AAVhu.43, AAVhu.44, AAVhu.44R1, AAVhu.44R2, AAVhu.44R3, AAVhu.45, AAVhu.46, AAVhu.47, AAVhu.48, AAVhu.48R1, AAVhu.48R2, AAVhu.48R3, AAVhu.49, AAVhu.5, AAVhu.51, AAVhu.52, AAVhu.53, AAVhu.54, AAVhu.55, AAVhu.56, AAVhu.57, AAVhu.58, AAVhu.6, AAVhu.60, AAVhu.61, AAVhu.63, AAVhu.64, AAVhu.66, AAVhu.67, AAVhu.7, AAVhu.8, AAVhu.9, AAVhu.t 19, AAVLG-10/rh.40, AAVLG-4/rh.38, AAVLG-9/hu.39, AAVLG-9/hu.39, AAV-LK01, AAV-LK02, AAVLK03, AAV-LK03, AAV- LK04, AAV-LK05, AAV-LK06, AAV-LK07, AAV-LK08, AAV-LK09, AAV-LK10, AAV-LK11, AAV-LK12, AAV-LK13, AAV-LK14, AAV-LK15, AAV-LK17, AAV-LK18, AAV-LK19, AAVN721-8/rh.43, AAV-PAEC, AAV-PAEC11, AAV-PAEC12, AAV-PAEC2, AAV-PAEC4, AAV-PAEC6, AAV-PAEC7, AAV-PAEC8, AAVpi.1, AAVpi.2, AAVpi.3, AAVrh.10, AAVrh.12, AAVrh.13, AAVrh.13R, AAVrh.14, AAVrh.17, AAVrh.18, AAVrh.19, AAVrh.2, AAVrh.20, AAVrh.21, AAVrh.22, AAVrh.23, AAVrh.24, AAVrh.25, AAVrh.2R, AAVrh.31, AAVrh.32, AAVrh.33, AAVrh.34, AAVrh.35, AAVrh.36, AAVrh.37, AAVrh.37R2, AAVrh.38, AAVrh.39, AAVrh.40, AAVrh.43, AAVrh.44, AAVrh.45, AAVrh.46, AAVrh.47, AAVrh.48, AAVrh.48, AAVrh.48.1, AAVrh.48.1.2, AAVrh.48.2, AAVrh.49, AAVrh.50, AAVrh.51, AAVrh.52, AAVrh.53, AAVrh.54, AAVrh.55, AAVrh.56, AAVrh.57, AAVrh.58, AAVrh.59, AAVrh.60, AAVrh.61, AAVrh.62, AAVrh.64, AAVrh.64R1, AAVrh.64R2, AAVrh.65, AAVrh.67, AAVrh.68, AAVrh.69, AAVrh.70, AAVrh.72, AAVrh.73, AAVrh.74, AAVrh.8, AAVrh.8R, AAVrh8R, AAVrh8R A586R mutant, AAVrh8R R533A mutant, BAAV, BNP61 AAV, BNP62 AAV, BNP63 AAV, bovine AAV, caprine AAV, Japanese AAV 10, true type AAV (ttAAV), UPENN AAV 10, AAV-LK16, AAAV, AAV Shuffle 100-1, AAV Shuffle 100-2, AAV Shuffle 100-3, AAV Shuffle 100-7, AAV Shuffle 10-2, AAV Shuffle 10-6, AAV Shuffle 10-8, AAV SM 100-10, AAV SM 100-3, AAV SM 10-1, AAV SM 10-2, and/or AAV SM 10-8.

In some aspects, the AAV serotype may be, or have, a mutation in the AAV9 sequence as described by N Pulicherla et al. (Molecular Therapy 19(6):1070-1078 (2011)), such as but not limited to, AAV9.9, AAV9.11, AAV9.13, AAV9.16, AAV9.24, AAV9.45, AAV9.47, AAV9.61, AAV9.68, AAV9.84.

In some aspects, the AAV serotype may be, or have, a sequence as described in U.S. Pat. No. 6,156,303, such as, but not limited to, AAV3B (SEQ ID NO: 1 and 10 of U.S. Pat. No. 6,156,303), AAV6 (SEQ ID NO: 2, 7 and 11 of U.S. Pat. No. 6,156,303), AAV2 (SEQ ID NO: 3 and 8 of U.S. Pat. No. 6,156,303), AAV3A (SEQ ID NO: 4 and 9, of U.S. Pat. No. 6,156,303), or derivatives thereof.

In some aspects, the serotype may be AAVDJ or a variant thereof, such as AAVDJ8 (or AAV-DJ8), as described by Grimm et al. (Journal of Virology 82(12): 5887-5911 (2008)). The amino acid sequence of AAVDJ8 may comprise two or more mutations in order to remove the heparin binding domain (HBD). As a non-limiting example, the AAV-DJ sequence described as SEQ ID NO: 1 in U.S. Pat. No. 7,588,772, may comprise two mutations: (1) R587Q where arginine (R; Arg) at amino acid 587 is changed to glutamine (Q; Gln) and (2) R590T where arginine (R; Arg) at amino acid 590 is changed to threonine (T; Thr). As another non-limiting example, may comprise three mutations: (1) K406R where lysine (K; Lys) at amino acid 406 is changed to arginine (R; Arg), (2) R587Q where arginine (R; Arg) at amino acid 587 is changed to glutamine (Q; Gln) and (3) R590T where arginine (R; Arg) at amino acid 590 is changed to threonine (T; Thr).

In some aspects, the AAV serotype may be, or have, a sequence as described in International Publication No. WO2015121501, such as, but not limited to, true type AAV (ttAAV) (SEQ ID NO: 2 of WO2015121501), "UPenn AAV10" (SEQ ID NO: 8 of WO2015121501), "Japanese AAV10" (SEQ ID NO: 9 of WO2015121501), or variants thereof.

According to the present disclosure, AAV capsid serotype selection or use may be from a variety of species. In one example, the AAV may be an avian AAV (AAAV). The AAAV serotype may be, or have, a sequence as described in U.S. Pat. No. 9,238,800, such as, but not limited to, AAAV (SEQ ID NO: 1, 2, 4, 6, 8, 10, 12, and 14 of U.S. Pat. No. 9,238,800), or variants thereof.

In one example, the AAV may be a bovine AAV (BAAV). The BAAV serotype may be, or have, a sequence as described in U.S. Pat. No. 9,193,769, such as, but not limited to, BAAV (SEQ ID NO: 1 and 6 of U.S. Pat. No. 9,193,769), or variants thereof. The BAAV serotype may be or have a sequence as described in U.S. Pat. No. 7,427,396, such as, but not limited to, BAAV (SEQ ID NO: 5 and 6 of U.S. Pat. No. 7,427,396), or variants thereof.

In one example, the AAV may be a caprine AAV. The caprine AAV serotype may be, or have, a sequence as described in U.S. Pat. No. 7,427,396, such as, but not limited to, caprine AAV (SEQ ID NO: 3 of U.S. Pat. No. 7,427,396), or variants thereof.

In other examples, the AAV may be engineered as a hybrid AAV from two or more parental serotypes. In one example, the AAV may be AAV2G9 which comprises sequences from AAV2 and AAV9. The AAV2G9 AAV serotype may be, or have, a sequence as described in U.S. Patent Publication No. 20160017005.

In one example, the AAV may be a serotype generated by the AAV9 capsid library with mutations in amino acids 390-627 (VP1 numbering) as described by Pulicherla et al. (Molecular Therapy 19(6):1070-1078 (2011). The serotype and corresponding nucleotide and amino acid substitutions may be, but is not limited to, AAV9.1 (G1594C; D532H), AAV6.2 (T1418A and T1436X; V473D and I479K), AAV9.3 (T1238A; F413Y), AAV9.4 (T1250C and A1617T; F417S), AAV9.5 (A1235G, A1314T, A1642G, C1760T; Q412R, T548A, A587V), AAV9.6 (T1231A; F411I), AAV9.9 (G1203A, G1785T; W595C), AAV9.10 (A1500G, T1676C; M559T), AAV9.11 (A1425T, A1702C, A1769T; T568P, Q590L), AAV9.13 (A1369C, A1720T; N457H, T574S), AAV9.14 (T1340A, T1362C, T1560C, G1713A; L447H), AAV9.16 (A1775T; Q592L), AAV9.24 (T1507C, T1521G; W503R), AAV9.26 (A1337G, A1769C; Y446C, Q590P), AAV9.33 (A1667C; D556A), AAV9.34 (A1534G, C1794T; N512D), AAV9.35 (A1289T, T1450A, C1494T, A1515T, C1794A, G1816A; Q430L, Y484N, N98K, V606I), AAV9.40 (A1694T, E565V), AAV9.41 (A1348T, T1362C; T450S), AAV9.44 (A1684C, A1701T, A1737G; N562H, K567N), AAV9.45 (A1492T, C1804T; N498Y, L602F), AAV9.46 (G1441C, T1525C, T1549G; G481R, W509R, L517V), 9.47 (G1241A, G1358A, A1669G, C1745T; S414N, G453D, K557E, T582I), AAV9.48 (C1445T, A1736T; P482L, Q579L), AAV9.50 (A1638T, C1683T, T1805A; Q546H, L602H), AAV9.53 (G1301A, A1405C, C1664T, G1811T; R134Q, S469R, A555V, G604V), AAV9.54 (C1531A, T1609A; L511I, L537M), AAV9.55 (T1605A; F535L), AAV9.58 (C1475T, C1579A; T492I, H527N), AAV.59 (T1336C; Y446H), AAV9.61 (A1493T; N498I), AAV9.64 (C1531A, A1617T; L511I), AAV9.65 (C1335T, T1530C, C1568A; A523D), AAV9.68 (C1510A; P504T), AAV9.80 (G1441A,G481R), AAV9.83 (C1402A, A1500T; P468T, E500D), AAV9.87 (T1464C, T1468C; S490P), AAV9.90 (A1196T; Y399F), AAV9.91 (T1316G, A1583T, C1782G, T1806C; L439R, K528I), AAV9.93 (A1273G, A1421G, A1638C, C1712T, G1732A, A1744T, A1832T; S425G, Q474R, Q546H, P571L, G578R, T582S, D611V), AAV9.94 (A1675T; M559L) and AAV9.95 (T1605A; F535L).

In one example, the AAV may be a serotype comprising at least one AAV capsid CD8+ T-cell epitope. As a non-limiting example, the serotype may be AAV1, AAV2 or AAV8.

In one example, the AAV may be a variant, such as PHP.A or PHP.B as described in Deverman. 2016. Nature Biotechnology. 34(2): 204-209.

In one example, the AAV may be a serotype selected from any of those found in SEQ ID NOs: 4734-5302 and Table 2.

In one example, the AAV may be encoded by a sequence, fragment or variant as disclosed in SEQ ID NOs: 4734-5302 and Table 2.

General principles of rAAV production are reviewed in, for example, Carter, 1992, Current Opinions in Biotechnology, 1533-539; and Muzyczka, 1992, Curr. Topics in Microbial. and Immunol., 158:97-129). Various approaches are described in Ratschin et al., Mol. Cell. Biol. 4:2072 (1984); Hermonat et al., Proc. Natl. Acad. Sci. USA, 81:6466 (1984); Tratschin et al., Mol. Cell. Biol. 5:3251 (1985); McLaughlin et al., J. Virol., 62:1963 (1988); and Lebkowski et al., 1988 Mol. Cell. Biol., 7:349 (1988). Samulski et al. (1989, J. Virol., 63:3822-3828); U.S. Pat. No. 5,173,414; WO 95/13365 and corresponding U.S. Pat. No. 5,658,776; WO 95/13392; WO 96/17947; PCT/US98/18600; WO 97/09441 (PCT/US96/14423); WO 97/08298 (PCT/US96/13872); WO 97/21825 (PCT/US96/20777); WO 97/06243 (PCT/FR96/01064); WO 99/11764; Perrin et al. (1995) Vaccine 13:1244-1250; Paul et al. (1993) Human Gene Therapy 4:609-615; Clark et al. (1996) Gene Therapy 3:1124-1132; U.S. Pat. Nos. 5,786,211; 5,871,982; and 6,258,595.

AAV vector serotypes can be matched to target cell types. For example, the following exemplary cell types can be transduced by the indicated AAV serotypes among others.

TABLE 2

Tissue/Cell Types and Serotypes

| Tissue/Cell Type | Serotype |
| --- | --- |
| Liver | AAV3, AAV8, AAV5, AAV9 |
| Skeletal muscle | AAV1, AAV7, AAV6, AAV8, AAV9 |
| Central nervous system | AAV5, AAV1, AAV4, AAV9 |
| RPE | AAV5, AAV4 |
| Photoreceptor cells | AAV5 |
| Lung | AAV9 |
| Heart | AAV8 |
| Pancreas | AAV8 |
| Kidney | AAV2, AAV8 |
| Hematopoietic stem cells | AAV6 |

In addition to adeno-associated viral vectors, other viral vectors can be used. Such viral vectors include, but are not limited to, lentivirus, alphavirus, enterovirus, pestivirus, baculovirus, herpesvirus, Epstein Barr virus, papovavirus, poxvirus, vaccinia virus, and herpes simplex virus.

In some aspects, Cas9 mRNA, sgRNA targeting one or two sites in SCN9A gene, and donor DNA can each be separately formulated into lipid nanoparticles, or are all co-formulated into one lipid nanoparticle.

In some aspects, Cas9 mRNA can be formulated in a lipid nanoparticle, while sgRNA and donor DNA can be delivered in an AAV vector.

Options are available to deliver the Cas9 nuclease as a DNA plasmid, as mRNA or as a protein. The guide RNA can be expressed from the same DNA, or can also be delivered as an RNA. The RNA can be chemically modified to alter or improve its half-life, or decrease the likelihood or degree of immune response. The endonuclease protein can be complexed with the gRNA prior to delivery. Viral vectors allow efficient delivery; split versions of Cas9 and smaller orthologs of Cas9 can be packaged in AAV, as can donors for HDR. A range of non-viral delivery methods also exist that can deliver each of these components, or non-viral and viral methods can be employed in tandem. For example, nanoparticles can be used to deliver the protein and guide RNA, while AAV can be used to deliver a donor DNA.

In some aspects of the in vivo based therapy described herein, the viral vector(s) encoding the endonuclease, guide RNA and/or donor DNA may be delivered to the neurons of the peripheral neural system, such as primary sensory and motor neurons, via direct intraganglionic or intraspinal injection, or intrathecal delivery (Hoyng et al., Front Mol Neurosci. 2015 Jul. 15; 8:32).

IV. Dosing and Administration

The terms "administering," "introducing" and "transplanting" are used interchangeably in the context of the placement of cells, e.g., progenitor cells, into a subject, by a method or route that results in at least partial localization of the introduced cells at a desired site, such as a site of injury or repair, such that a desired effect(s) is produced. The cells e.g., progenitor cells, or their differentiated progeny can be administered by any appropriate route that results in delivery to a desired location in the subject where at least a portion of the implanted cells or components of the cells remain viable. The period of viability of the cells after administration to a subject can be as short as a few hours, e.g., twenty-four hours, to a few days, to as long as several years, or even the life time of the patient, i.e., long-term engraftment. For example, in some aspects described herein, an effective amount of progenitor cells is administered via a systemic route of administration, such as an intraperitoneal or intravenous route.

The terms "individual," "subject," "host" and "patient" are used interchangeably herein and refer to any subject for whom diagnosis, treatment or therapy is desired. In some aspects, the subject is a mammal. In some aspects, the subject is a human being.

When provided prophylactically, progenitor cells described herein can be administered to a subject in advance of any symptom of pain. Accordingly, the prophylactic administration of a progenitor cell population serves to prevent pain.

A progenitor cell population being administered according to the methods described herein can comprise allogeneic progenitor cells obtained from one or more donors. Such progenitors may be of any cellular or tissue origin, e.g., liver, muscle, cardiac, etc. "Allogeneic" refers to a progenitor cell or biological samples comprising progenitor cells obtained from one or more different donors of the same species, where the genes at one or more loci are not identical. For example, a liver progenitor cell population being administered to a subject can be derived from one more unrelated donor subjects, or from one or more non-identical siblings. In some cases, syngeneic progenitor cell populations can be used, such as those obtained from genetically identical animals, or from identical twins. The progenitor cells can be autologous cells; that is, the progenitor cells are obtained or isolated from a subject and administered to the same subject, i.e., the donor and recipient are the same.

The term "effective amount" refers to the amount of a population of progenitor cells or their progeny needed to prevent or alleviate at least one or more signs or symptoms of pain, and relates to a sufficient amount of a composition to provide the desired effect, e.g., to treat a subject having pain. The term "therapeutically effective amount" therefore refers to an amount of progenitor cells or a composition comprising progenitor cells that is sufficient to promote a particular effect when administered to a typical subject, such as one who has or is at risk for pain. An effective amount would also include an amount sufficient to prevent or delay the development of a symptom of the disease, alter the course of a symptom of the disease (for example but not limited to, slow the progression of a symptom of the disease), or reverse a symptom of the disease. It is understood that for any given case, an appropriate "effective amount" can be determined by one of ordinary skill in the art using routine experimentation.

For use in the various aspects described herein, an effective amount of progenitor cells comprises at least $10^2$ progenitor cells, at least $5 \times 10^2$ progenitor cells, at least $10^3$ progenitor cells, at least $5 \times 10^3$ progenitor cells, at least $10^4$ progenitor cells, at least $5 \times 10^4$ progenitor cells, at least $10^5$ progenitor cells, at least $2 \times 10^5$ progenitor cells, at least $3 \times 10^5$ progenitor cells, at least $4 \times 10^5$ progenitor cells, at least $5 \times 10^5$ progenitor cells, at least $6 \times 10^5$ progenitor cells, at least $7 \times 10^5$ progenitor cells, at least $8 \times 10^5$ progenitor cells, at least $9 \times 10^5$ progenitor cells, at least $1 \times 10^6$ progenitor cells, at least $2 \times 10^6$ progenitor cells, at least $3 \times 10^6$ progenitor cells, at least $4 \times 10^6$ progenitor cells, at least $5 \times 10^6$ progenitor cells, at least $6 \times 10^6$ progenitor cells, at least $7 \times 10^6$ progenitor cells, at least $8 \times 10^6$ progenitor cells, at least $9 \times 10^6$ progenitor cells, or multiples thereof. The progenitor cells can be derived from one or more donors, or can be obtained from an autologous source. In some examples described herein, the progenitor cells can be expanded in culture prior to administration to a subject in need thereof.

Modest and incremental decreases in the levels of SCN9A expressed in cells of patients having pain can be beneficial for ameliorating one or more symptoms of the disease, for increasing long-term survival, and/or for reducing side effects associated with other treatments. Upon administration of such cells to human patients, the presence of progenitors that are producing decreased levels of SCN9A is beneficial. In some cases, effective treatment of a subject gives rise to at least about 3%, 5% or 7% reduction in SCN9A relative to total SCN9A in the treated subject. In some examples, the reduction in SCN9A will be at least about 10% of total SCN9A. In some examples, the reduction in SCN9A will be at least about 20% to 30% of total SCN9A. Similarly, the introduction of even relatively limited subpopulations of cells having significantly reduced levels of SCN9A can be beneficial in various patients because in some situations normalized cells will have a selective advantage relative to diseased cells. However, even modest levels of progenitors with reduced levels of SCN9A can be beneficial for ameliorating one or more aspects of Pain in patients. In some examples, about 10%, about 20%, about 30%, about 40%, about 50%, about 60%, about 70%, about 80%, about 90% or more of the progenitors in patients to whom such cells are administered are producing decreased levels of SCN9A.

"Administered" refers to the delivery of a progenitor cell composition into a subject by a method or route that results in at least partial localization of the cell composition at a desired site. A cell composition can be administered by any appropriate route that results in effective treatment in the subject, i.e. administration results in delivery to a desired location in the subject where at least a portion of the composition delivered, i.e. at least $1 \times 10^4$ cells are delivered to the desired site for a period of time.

In one aspect of the method, the pharmaceutical composition may be administered via a route such as, but not limited to, enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebellomedularis), intracorneal (within the cornea), dental intracornal, intracoronary (within the coronary arteries), intracorporus cavernosum (within the dilatable spaces of the corporus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intramyocardial (within the myocardium), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration, which is then covered by a dressing that occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), intramyocardial (entering the myocardium), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis and spinal.

Modes of administration include injection, infusion, instillation, and/or ingestion. "Injection" includes, without limitation, intravenous, intramuscular, intra-arterial, intrathecal, intraventricular, intracapsular, intraorbital, intracardiac, intradermal, intraperitoneal, transtracheal, subcutaneous, subcuticular, intraarticular, sub capsular, subarachnoid, intraspinal, intracerebro spinal, and intrasternal injection and infusion. In some examples, the route is intravenous. For the delivery of cells, administration by injection or infusion can be made.

The cells can be administered systemically. The phrases "systemic administration," "administered systemically", "peripheral administration" and "administered peripherally" refer to the administration of a population of progenitor cells other than directly into a target site, tissue, or organ, such that it enters, instead, the subject's circulatory system and, thus, is subject to metabolism and other like processes.

The efficacy of a treatment comprising a composition for the treatment of pain can be determined by the skilled clinician. However, a treatment is considered "effective treatment," if any one or all of the signs or symptoms of, as but one example, levels of SCN9A are altered in a beneficial manner (e.g., decreased by at least 10%), or other clinically accepted symptoms or markers of disease are improved or ameliorated. Efficacy can also be measured by failure of an individual to worsen as assessed by hospitalization or need for medical interventions (e.g., progression of the disease is halted or at least slowed). Methods of measuring these indicators are known to those of skill in the art and/or described herein. Treatment includes any treatment of a disease in an individual or an animal (some non-limiting examples include a human, or a mammal) and includes: (1) inhibiting the disease, e.g., arresting, or slowing the progression of symptoms; or (2) relieving the disease, e.g., causing regression of symptoms; and (3) preventing or reducing the likelihood of the development of symptoms.

The treatment according to the present disclosure can ameliorate one or more symptoms associated with pain by decreasing or altering the amount of the SCN9A protein in the individual.

V. Features and Properties of the Sodium Channel, Voltage Gated, Type IX Alpha Subunit (Scn9a) Gene SCN9A has been associated with diseases and disorders such as, but not limited to, Congenital Pain Insensitivity, Anosmia, As If Personality, Borderline Personality Disorder, Malignant neoplasm of breast, Non-Small Cell Lung Carcinoma, Cold intolerance, Febrile Convulsions, Diabetes, Diabetes Mellitus, Dissociative disorder, Epilepsy, Erythromelalgia, Primary Erythermalgia, Facial Pain, Herpesviridae Infections, Hereditary Sensory Autonomic Neuropathy Type 5, Hyperplasia, Neuralgia, Hereditary Sensory and Autonomic Neuropathies, Degenerative polyarthritis, Pain, Pain in limb, Postoperative Pain, Parkinson Disease, Postherpetic neuralgia, Prostatic Neoplasms, Pruritus, Seizures, Somatoform Disorder, Tobacco Use Disorder, Trigeminal Neuralgia, Synovial Cyst, Chronic pain, Acute onset pain, Paramyotonia Congenita (disorder), Malaise, Sensory Discomfort, Burning Pain, Indifference to pain, Inflammatory pain, Mechanical pain, Scalp pain, Hereditary Motor and Sensory-Neuropathy Type II, Common Migraine, Absence of pain sensation, Malignant neoplasm of prostate, Pain Disorder, Knee Osteoarthritis, Neuropathy, Complex Regional Pain Syndromes, Tonic-clonic seizures, Inherited neuropathies, Prostate carcinoma, Breast Carcinoma, Infantile Severe Myoclonic Epilepsy, Myxoid cyst, Channelopathies, Paroxysmal Extreme Pain Disorder, Painful Neuropathy, Compressive Neuropathies, Congenital Indifference to Pain Autosomal Recessive, Generalized Epilepsy With Febrile Seizures Plus Type 2, Generalized Epilepsy With Febrile Seizures Plus 7, Febrile Seizures Familial 3B, and Small Fiber Neuropathy (Adult-onset is referred to as small fiber neuropathy). Editing the SCN9A gene using any of the methods described herein may be used to treat, prevent and/or mitigate the symptoms of the diseases and disorders described herein.

The SCN9A gene encodes the alpha subunit of a sodium channel named NaV1.7. NaV1.7 is primarily expressed in sensory neurons and plays a significant role in nociception signaling. Mutations in the SCN9A gene are known to cause pain perception disorders, including primary erythermalgia, paroxysmal extreme pain disorder, congenital insensitivity to pain, and small fiber neuropathy. Gain-of-function mutations in the SCN9A gene result in spontaneous pain as observed in primary erythermalgia and paroxysmal extreme pain disorder. Thus, knock-out or knock-down of the SCN9A gene in patients having primary erythromelalgia or paroxysmal extreme pain disorder can be used to treat, prevent and/or mitigate the associated symptoms.

Primary erythromelalgia is a rare autosomal dominant disorder characterized by episodes of burning pain in the feet and hands in response to heat and movement. Affected individuals typically develop signs and symptoms in early childhood, although in milder cases symptoms can appear later in life. Management of this condition is mainly symptomatic. Besides avoidance of pain triggers (such as heat, exercise, and alcohol), treatment options include cooling and elevating the extremity, use of anesthetics such as lidocaine and mexilitine, and use of opioid drugs in extreme cases.

Paroxysmal extreme pain disorder is another rare disorder characterized by severe episodic pain in rectal, ocular, and mandibular regions as well as skin redness. Symptoms of this condition often begin in the neonatal period or in the early childhood, and can retain throughout life. Agents for treating chronic neuropathic pain disorders are often used to alleviate the pain episodes caused by the disease. Carbamazepine, a sodium channel blocker, has proven most effective of these treatments.

In one example, the gene is Sodium Channel, Voltage Gated, Type IX Alpha Subunit (SCN9A) which may also be referred to Sodium Voltage-Gated Channel Alpha Subunit 9, Sodium Channel, Voltage-Gated, Type IX, Alpha Polypeptide, Voltage-Gated Sodium Channel Subunit Alpha Nav1.7, Sodium Channel Protein Type IX Subunit Alpha, Neuroendocrine Sodium Channel, Peripheral Sodium Channel 1, HNE-Na, NENA, PN1, GEFSP7, HSAN2D, Nav1.7, FEB3B, ETHA, and SFNP. SCN9A has a cytogenetic location of 2q24.3 and the genomic coordinate are on Chromosome 2 on the forward strand at position 166,195,185-166,375,993. The nucleotide sequence of SCN9A is shown as SEQ ID NO: 5303. SCN7A is the gene upstream of SCN9A on the reverse strand and RN7SKP152 is the gene downstream of SCN9A on the reverse strand. AC010127.3 is a gene located on the forward strand opposite of SCN9A. SCN9A has a NCBI gene ID of 6335, Uniprot ID of Q15858 and Ensembl Gene ID of ENSG00000169432. SCN9A has 3906 SNPs, 39 introns and 38 exons. The exon identifier from Ensembl and the start/stop sites of the introns and exons are shown in Table 3.

TABLE 3

Introns and Exons for SCN9A

| Exon No. | Exon ID | Start/Stop | Intron No. | Intron based on Exon ID | Start/Stop |
|---|---|---|---|---|---|
| EX1 | ENSE00001589707 | 166,375,993-166,375,697 | INT1 | Intron ENSE00001589707-ENSE00001584414 | 166,375,696-166,311,807 |
| EX2 | ENSE00001584414 | 166,311,806-166,311,499 | INT2 | Intron ENSE00001584414-ENSE00001585608 | 166,311,498-166,307,075 |
| EX3 | ENSE00001585608 | 166,307,074-166,306,956 | INT3 | Intron ENSE00001585608-ENSE00001578488 | 166,306,955-166,306,600 |
| EX4 | ENSE00001578488 | 166,306,599-166,306,510 | INT4 | Intron ENSE00001578488-ENSE00003608010 | 166,306,509-166,305,921 |
| EX5 | ENSE00003608010 | 166,305,920-166,305,792 | INT5 | Intron ENSE00003608010-ENSE00003584389 | 166,305,791-166,304,330 |
| EX6 | ENSE00003584389 | 166,304,329-166,304,238 | INT6 | Intron ENSE00003584389-ENSE00001129637 | 166,304,237-166,303,303 |
| EX7 | ENSE00001129637 | 166,303,302-166,303,090 | INT7 | Intron ENSE00001129637-ENSE00001128428 | 166,303,089-166,294,663 |
| EX8 | ENSE00001128428 | 166,294,662-166,294,599 | INT8 | Intron ENSE00001128428-ENSE00001128421 | 166,294,598-166,293,373 |
| EX9 | ENSE00001128421 | 166,293,372-166,293,231 | INT9 | Intron ENSE00001128421-ENSE00001128530 | 166,293,230-166,288,644 |
| EX10 | ENSE00001128530 | 166,288,643-166,288,437 | INT10 | Intron ENSE00001128530-ENSE00001128525 | 166,288,436-166,286,624 |
| EX11 | ENSE00001128525 | 166,286,623-166,286,336 | INT11 | Intron ENSE00001128525-ENSE00001585370 | 166,286,335-166,284,825 |
| EX12 | ENSE00001585370 | 166,284,824-166,284,486 | INT12 | Intron ENSE00001585370-ENSE00001128510 | 166,284,485-166,281,809 |
| EX13 | ENSE00001128510 | 166,281,808-166,281,679 | INT13 | Intron ENSE00001128510-ENSE00001128413 | 166,281,678-166,280,596 |
| EX14 | ENSE00001128413 | 166,280,595-166,280,357 | INT14 | Intron ENSE00001128413-ENSE00002474880 | 166,280,356-166,278,314 |
| EX15 | ENSE00002474880 | 166,278,313-166,278,140 | INT15 | Intron ENSE00002474880-ENSE00002495223 | 166,278,139-166,277,340 |
| EX16 | ENSE00002495223 | 166,277,339-166,276,983 | INT16 | Intron ENSE00002495223-ENSE00001128485 | 166,276,982-166,272,876 |
| EX17 | ENSE00001128485 | 166,272,875-166,272,399 | INT17 | Intron ENSE00001128485-ENSE00001128480 | 166,272,398-166,251,886 |
| EX18 | ENSE00001128480 | 166,251,885-166,251,765 | INT18 | Intron ENSE00001128480-ENSE00001128404 | 166,251,764-166,242,657 |
| EX19 | ENSE00001128404 | 166,242,656-166,242,502 | INT19 | Intron ENSE00001128404-ENSE00001128471 | 166,242,501-166,238,268 |
| EX20 | ENSE00001128471 | 166,238,267-166,238,094 | INT20 | Intron ENSE00001128471-ENSE00001128466 | 166,238,093-166,233,463 |
| EX21 | ENSE00001128466 | 166,233,462-166,233,340 | INT21 | Intron ENSE00001128466-ENSE00001128459 | 166,233,339-166,228,973 |
| EX22 | ENSE00001128459 | 166,228,972-166,228,691 | INT22 | Intron ENSE00001128459-ENSE00001128456 | 166,228,690-166,227,724 |
| EX23 | ENSE00001128456 | 166,227,723-166,227,670 | INT23 | Intron ENSE00001128456-ENSE00002481484 | 166,227,669-166,226,705 |
| EX24 | ENSE00002481484 | 166,226,704-166,226,567 | INT24 | Intron ENSE00002481484-ENSE00001128397 | 166,226,566-166,204,465 |
| EX25 | ENSE00001128397 | 166,204,464-166,204,360 | INT25 | Intron ENSE00001128397-ENSE00001128443 | 166,204,359-166,204,226 |
| EX26 | ENSE00001128443 | 166,204,225-166,203,955 | INT26 | Intron ENSE00001128443-ENSE00001128389 | 166,203,954-166,199,865 |
| EX27 | ENSE00001128389 | 166,199,864-166,195,185 | INT27 | Intron ENSE00001638161-ENSE00003608010 | 166,306,509-166,305,921 |
| EX28 | ENSE00001638161 | 166,306,571-166,306,510 | INT28 | Intron ENSE00003608010-ENSE00002527733 | 166,305,791-166,304,123 |
| EX29 | ENSE00002527733 | 166,304,122-166,304,031 | INT29 | Intron ENSE00002527733-ENSE00001129637 | 166,304,030-166,303,303 |
| EX30 | ENSE00001728682 | 166,281,808-166,281,760 | INT30 | Intron ENSE00001585370-ENSE00001728682 | 166,284,485-166,281,809 |
| EX31 | ENSE00001128517 | 166,284,824-166,284,453 | INT31 | Intron ENSE00001128525-ENSE00001128517 | 166,286,335-166,284,825 |
| EX32 | ENSE00001578080 | 166,311,756-166,311,499 | INT32 | Intron ENSE00001128517-ENSE00001728682 | 166,284,452-166,281,809 |
| EX33 | ENSE00001577861 | 166,199,864-166,198,672 | INT33 | Intron ENSE00001578080-ENSE00001585608 | 166,311,498-166,307,075 |
| EX34 | ENSE00003545902 | 166,305,920-166,305,792 | INT34 | Intron ENSE00001128517-ENSE00001128510 | 166,284,452-166,281,809 |

TABLE 3-continued

Introns and Exons for SCN9A

| Exon No. | Exon ID | Start/Stop | Intron No. | Intron based on Exon ID | Start/Stop |
|---|---|---|---|---|---|
| EX35 | ENSE00003645381 | 166,304,329-166,304,238 | INT35 | Intron ENSE00001128443-ENSE00001577861 | 166,203,954-166,199,865 |
| EX36 | ENSE00001934531 | 166,303,302-166,302,619 | INT36 | Intron ENSE00003545902-ENSE00003645381 | 166,305,791-166,304,330 |
| EX37 | ENSE00002257282 | 166,375,987-166,375,697 | INT37 | Intron ENSE00003645381-ENSE00001934531 | 166,304,237-166,303,303 |
| EX38 | ENSE00002232442 | 166,199,864-166,195,194 | INT38 | Intron ENSE00002257282-ENSE00001584414 | 166,375,696-166,311,807 |
|  |  |  | INT39 | Intron ENSE00001128443-ENSE00002232442 | 166,203,954-166,199,865 |

Table 4 provides information on all of the transcripts for the SCN9A gene based on the Ensembl database. Provided in Table 4 are the transcript ID from Ensembl and corresponding NCBI RefSeq ID for the transcript, the translation ID from Ensembl and the corresponding NCBI RefSeq ID for the protein, the biotype of the transcript sequence as classified by Ensembl and the exons and introns in the transcript based on the information in Table 3.

TABLE 4

Transcript Information for SCN9A

| Transcript ID | Transcript NCBI RefSeq ID | Translation ID | Protein NCBI RefSeq ID | Sequence Biotype | Exon ID from Table 3 | Intron ID from Table 3 |
|---|---|---|---|---|---|---|
| ENST00000409672.5 | NM_002977 | ENSP00000386306 | NP_002968 | Protein coding | EX1, EX2, EX3, EX4, EX5, EX6, EX7, EX8, EX9, EX10, EX11, EX12, EX13, EX14, EX15, EX16, EX17, EX18, EX19, EX20, EX21, EX22, EX23, EX24, EX25, EX26, EX27 | INT1, INT2, INT3, INT4, INT5, INT6, INT7, INT8, INT9, INT10, INT11, INT12, INT13, INT14, INT15, INT16, INT17, INT18, INT19, INT20, INT21, INT22, INT23, INT24, INT25, INT26 |
| ENST00000303354.10 | — | ENSP00000304748 | — | Protein coding | EX2, EX3, EX4, EX5, EX6, EX7, EX8, EX9, EX10, EX11, EX13, EX14, EX15, EX16, EX17, EX18, EX19, EX20, EX21, EX22, EX23, EX24, EX25, EX26, EX31, EX37, EX38 | INT2, INT3, INT4, INT5, INT6, INT7, INT8, INT9, INT10, INT13, INT14, INT15, INT16, INT17, INT18, INT19, INT20, INT21, INT22, INT23, INT24, INT25, INT31, INT34, INT38, INT39 |
| ENST00000409435.5 | — | ENSP00000386330 | — | Protein coding | EX3, EX4, EX5, EX6, EX7, EX8, EX9, EX10, EX11, EX13, EX14, EX15, EX16, EX17, EX18, EX19, EX20, EX21, EX22, EX23, EX24, EX25, EX26, EX31, EX32, EX33 | INT3, INT4, INT5, INT6, INT7, INT8, INT9, INT10, INT13, INT14, INT15, INT16, INT17, INT18, INT19, INT20, INT21, INT22, INT23, INT24, INT25, INT31, INT33, INT34, INT35 |
| ENST00000452182.1 | — | ENSP00000393141 | — | Protein coding | EX5, EX7, EX8, EX9, EX10, EX11, EX28, EX29, EX30, EX31 | INT7, INT8, INT9, INT10, INT27, INT28, INT29, INT31, INT32 |

TABLE 4-continued

Transcript Information for SCN9A

| Transcript ID | Transcript NCBI RefSeq ID | Translation ID | Protein NCBI RefSeq ID | Sequence Biotype | Exon ID from Table 3 | Intron ID from Table 3 |
|---|---|---|---|---|---|---|
| ENST00000454569.5 | — | ENSP00000413212 | — | Protein coding | EX5, EX7, EX8, EX9, EX10, EX11, EX12, EX28, EX29, EX30 | INT7, INT8, INT9, INT10, INT11, INT27, INT28, INT29, INT30 |
| ENST00000472119.1 | — | — | — | Retained intron | EX34, EX35, EX36 | INT36, INT37 |

SCN9A has 3906 SNPs and the NCBI rs number and/or UniProt VAR number for this SCN9A gene are VAR_019947, VAR_019948, VAR_019949, VAR_019950, VAR_030444, VAR_032014, VAR_032015, VAR_032016, VAR_032017, VAR_032018, VAR_032019, VAR_032020, VAR_032021, VAR_032022, VAR_032023, VAR_064595, VAR_064596, VAR_064597, VAR_064598, VAR_071428908, VAR_064600, VAR_064601, VAR_064602, VAR_064603, VAR_064604, VAR_064605, VAR_064606, VAR_064607, VAR_064608, VAR_064609, VAR_064610, VAR_064611, VAR_064612, VAR_064613, VAR_072279, VAR_072280, VAR_072280, VAR_072281, rs951510, rs952462, rs952463, rs1011778, rs1358532, rs1406272, rs1540870, rs1540871, rs1540875, rs1919177, rs1881436, rs1881437, rs1881438, rs1881439, rs1997291, rs1528481, rs1528483, rs1528484, rs1528487, rs2893013, rs4131159, rs4131160, rs4131632, rs4488677, rs4408747, rs4331519, rs4429487, rs4001001, rs4273234, rs4583483, rs4438497, rs4286289, rs4546021, rs4455168, rs4455169, rs4605385, rs4465779, rs4384809, rs4386335, rs4667512, rs5836099, rs6432898, rs6432899, rs6432900, rs6432901, rs6432902, rs6432903, rs6432904, rs6432905, rs6432906, rs6432907, rs6432910, rs6723900, rs6720769, rs6715214, rs6712015, rs6712019, rs6708450, rs6708715, rs6725355, rs6725732, rs6722807, rs6716736, rs6723160, rs6726575, rs6760472, rs6723789, rs6728885, rs6738419, rs6729030, rs6732627, rs6719276, rs6729980, rs6738102, rs6750593, rs6756635, rs6718922, rs6718791, rs6757555, rs6731773, rs6715367, rs7577446, rs6715470, rs6757555, rs6731773, rs6715367, rs7577446, rs6732135, rs6714902, rs6757862, rs6746587, rs6721003, rs7558866, rs6432909, rs7584766, rs7589477, rs7584892, rs7559171, rs6432908, rs7590179, rs7572553, rs7566965, rs7602898, rs6432897, rs6432896, rs7580299, rs7603335, rs7597876, rs4667883, rs4667882, rs7582061, rs9287866, rs5836096, rs10171225, rs4564789, rs7594979, rs4459751, rs7606521, rs4599137, rs9646771, rs4076255, rs4447616, rs4443015, rs10188002, rs3956542, rs4132348, rs4132347, rs4131162, rs4131161, rs1528486, rs1528485, rs1881440, rs1609311, rs1540876, rs1540874, rs10930216, rs10930217, rs10930218, rs10930219, rs1540873, rs1540872, rs6728894, rs11280107, rs11686478, rs7424841, rs12105034, rs13000874, rs6734919, rs11674528, rs12692794, rs12692795, rs6753017, rs6744871, rs6736291, rs11340941, rs12478446, rs6757314, rs13004059, rs11693091, rs6757502, rs6737120, rs6732242, rs12463992, rs12612992, rs12464575, rs13417859, rs13395456, rs12615462, rs6746615, rs7420705, rs13027418, rs12616699, rs12467272, rs11898284, rs7589743, rs16851931, rs7597083, rs7597178, rs16851958, rs16851960, rs7598695, rs7592978, rs16851968, rs9759544, rs7606196, rs16852023, rs16852031, rs16852043, rs16852048, rs16852054, rs16852069, rs13030011, rs11899120, rs13013237, rs12469343, rs7606274, rs13401294, rs12992260, rs10190952, rs9646772, rs7608288, rs10193767, rs10538478, rs12994338, rs13016545, rs12994880, rs13405544, rs13034090, rs13017469, rs10556841, rs13017637, rs11888456, rs10600584, rs13035164, rs10611611, rs10634344, rs12473416, rs13431341, rs13020056, rs10638743, rs13021236, rs12999243, rs13000233, rs13000683, rs10655845, rs13387119, rs11435802, rs35244507, rs10688081, rs10696005, rs10710576, rs11463044, rs35280187, rs10497283, rs34327610, rs13390803, rs34920657, rs10497284, rs34355606, rs35730267, rs34926643, rs35333199, rs34936668, rs36101458, rs12476306, rs12105169, rs58078583, rs12692796, rs58159440, rs41268677, rs11890824, rs58184464, rs35789805, rs56058874, rs35353363, rs34490209, rs35821032, rs35360495, rs34449821, rs35425598, rs56999748, rs11681893, rs35473199, rs11682860, rs11676630, rs11693152, rs13004690, rs12615972, rs34617014, rs13026637, rs56149857, rs16851928, rs35911982, rs16851935, rs16851943, rs55681559, rs16851964, rs16851966, rs35542360, rs16851974, rs16852010, rs11885693, rs17766038, rs17766243, rs17766561, rs17766807, rs11901118, rs13426370, rs57275972, rs12993435, rs13427940, rs12472033, rs12622435, rs12622743, rs35187227, rs13035599, rs36035794, rs12996068, rs13021074, rs34784693, rs60461278, rs59265133, rs56282252, rs36096260, rs59348143, rs56292816, rs16826112, rs35257630, rs34813283, rs55945526, rs13411967, rs60930703, rs67175205, rs73025509, rs73025522, rs73025523, rs73025528, rs28532836, rs73025590, rs35683510, rs13391197, rs62176964, rs62176965, rs55989063, rs62178525, rs35433129, rs33999505, rs34533574, rs71428911, rs71428912, rs71428915, rs71428916, rs71428917, rs71428918, rs71428919, rs60050530, rs71428910, rs34038642, rs72149794, rs35077026, rs35080467, rs34582751, rs57073619, rs57087440, rs34082367, rs73972306, rs73972316, rs73972318, rs74336612, rs75477543, rs56152529, rs76673713, rs71031239, rs34099849, rs34101964, rs35129718, rs76710665, rs76711511, rs79030107, rs74445522, rs79031716, rs74449889, rs75597232, rs76740831, rs75608447, rs34132334, rs34649195, rs35552412, rs77937563, rs72882854, rs72882859, rs72882882, rs72882899, rs72882901, rs72884703, rs17766014, rs17766982, rs72884732, rs72884741, rs72884745, rs72884753, rs72884762, rs72884775, rs72884780, rs72884785, rs72884786, rs35962214, rs72884797, rs72884798, rs17817307, rs72884802, rs75675344, rs72886606, rs72886608, rs17817547, rs79140856, rs79147031, rs17817679, rs80356466, rs35182375, rs80356469, rs35595054, rs55754250, rs75773428, rs60310134, rs60392208, rs36073771, rs71395218, rs115848509, rs66472972, rs79202357, rs75794168, rs57861261, rs71405933, rs73025538, rs112373468, rs62176960, rs75818857, rs62176961, rs67339035, rs62178526, rs115911128, rs75848558, rs60056351, rs71428914, rs115946138, rs74706664, rs113603623, rs111285706, rs111302354, rs77046324, rs60145586, rs113610968, rs72330491, rs112490413, rs73969684, rs112504933, rs111337704, rs74757084, rs116013127, rs73969685, rs74768783, rs73969700, rs116037918, rs73969701, rs72520704, rs74385849, rs71031240, rs79417925, rs74791755, rs71031242, rs74423851, rs75620229, rs79061212, rs75645300, rs113739900, rs72884720, rs113758466, rs72884726, rs72884789, rs72884800, rs78215125, rs75709114, rs77151034, rs77154470, rs111426485, rs80356465, rs80356468, rs114760918, rs80356470, rs114985967, rs79187718, rs74613934, rs112644902, rs76904702, rs111528010, rs78278362, rs115847294, rs112347596, rs115028579, rs113518536, rs78304745, rs79221441, rs79222523, rs112718465, rs115074698, rs113962992, rs111624869, rs75818591, rs115099720, rs74658674, rs75006765, rs115881388, rs113988866, rs114811473, rs111281728, rs111679051, rs75029843, rs112761603, rs78428931, rs112768548, rs113629537, rs111705022, rs111705421, rs75053746, rs78118515, rs79645790, rs115979359, rs113660887, rs114893976, rs78162977, rs114048544, rs115193623, rs75093813, rs78510947, rs77373314, rs76244722, rs112835924, rs76247525, rs113698317, rs78552930, rs74778123, rs116048770, rs116373723, rs75949647, rs114920745, rs116069340, rs112869318, rs114923155, rs114926041, rs115322950, rs113737673, rs112561342, rs77143068, rs79446427, rs111404258, rs112919255, rs111415017, rs75225428, rs111458233, rs112945476, rs111470787, rs79493055, rs116451742, rs111899000, rs77487847, rs113850984, rs77192374, rs76448913, rs78250271, rs116188445, rs112675405, rs111948101, rs111953170, rs77231154, rs114267271, rs115435826, rs79853207, rs77579497, rs113911089, rs78334485, rs79876905, rs76510000, rs76102017, rs116547783, rs115473061, rs111643968, rs115489522, rs77639503, rs116268225, rs111654843, rs113989468, rs114344033, rs77682648, rs115119378, rs77328118, rs112779076, rs78452939, rs113173376, rs76571042, rs115522370, rs114032727, rs78863850, rs113195803, rs78454756, rs116653005, rs77784194, rs77797040, rs78906046, rs75468572, rs80095598, rs138982989, rs138989210, rs114358903, rs113283978, rs113182934, rs114525222, rs115555277, rs75069209, rs79684957, rs115244856, rs113309940, rs113311364, rs80160529, rs115251943, rs115274753, rs112867239, rs114118902, rs139080215, rs114143095, rs116773598, rs148713442, rs142480223, rs77432282, rs140701967, rs148765803, rs145478117, rs79741845, rs142518463, rs139170417, rs77441037, rs75200610, rs148846057, rs145575900, rs116422705, rs111858722, rs116435828, rs116962683, rs75230883, rs148931877, rs112947029, rs121908920, rs121908921, rs140792426, rs115783892, rs113436493, rs111884740, rs139281380, rs139288692, rs112970706, rs115393048, rs112995109, rs75273355, rs77539813, rs115812636, rs142707672, rs78731163, rs184266839, rs140830160, rs111972606, rs149102734, rs78763917, rs116547537, rs114319629, rs145811912, rs184317901, rs77642761, rs149157378, rs115495114, rs79918973, rs142779717, rs149194222, rs112047115, rs181405366, rs76564908, rs78843438, rs181423521, rs184404793, rs80126387, rs149285180, rs137950241, rs184447464, rs149297295, rs78947176, rs117581394, rs187270227, rs139017042, rs116710246, rs149301325, rs142909834, rs140574148, rs137962506, rs190380742, rs137966449, rs116713443, rs149350025, rs112222195, rs184515932, rs116748713, rs142952951, rs139064023, rs181563231, rs181572301, rs181577442, rs78998616, rs145366755, rs113361139, rs115726491, rs184560681, rs184561606, rs148819190, rs190457189, rs142559100, rs149429956, rs143007711, rs142585699, rs114681048, rs140761356, rs145608272, rs121908916, rs142666506, rs187410330, rs115802383, rs187428818, rs149490896, rs149507189, rs113450348, rs149034908, rs146213117, rs145737444, rs184675901, rs146234445, rs181717210, rs184685668, rs181276399, rs187500785, rs145769973, rs190597640, rs181734340, rs184275120, rs143161505, rs146267489, rs149592596, rs190625704, rs115823295, rs141042794, rs138081618, rs190666356, rs190668591, rs184760546, rs149648597, rs145798468, rs184289118, rs142753783, rs187145433, rs181814822, rs146333890, rs187164514, rs187187436, rs181818571, rs181414054, rs184784994, rs181414423, rs181840211, rs187627632, rs145969336, rs187630476, rs187638933, rs181864169, rs117600380, rs143281561, rs149739106, rs187660096, rs184471275, rs139433712, rs143307775, rs187686954, rs143323637, rs146453073, rs184491945, rs184503606, rs149812467, rs187735078, rs181543382, rs187739615, rs149846122, rs181976860, rs181544216, rs184525265, rs187760599, rs190446880, rs137993592, rs184557454, rs182005122, rs184956974, rs184558307, rs184973913, rs184975345, rs190455017, rs146114242, rs182041228, rs149440243, rs190971448, rs139677117, rs138238059, rs143020225, rs187396655, rs149989224, rs191004585, rs187404611, rs150021077, rs146148893, rs182164896, rs182169962, rs149458240, rs187420437, rs187457184, rs141218614, rs146210131, rs146758972, rs185134458, rs187483230, rs187499307, rs138051487, rs139537793, rs190630868, rs150115235, rs149656478, rs191129855, rs187982120, rs182221863, rs184769972, rs181809487, rs141258921, rs146330125, rs184777485, rs139562000, rs188023656, rs150184169, rs139564447, rs191220059, rs146882468, rs184798240, rs187628994, rs143699917, rs143713899, rs184829398, rs143292594, rs188117229, rs143733438, rs141345692, rs188123311, rs188145250, rs146953750, rs141083667, rs143769263, rs181942663, rs146963548, rs149811195, rs190856490, rs191334405, rs190873215, rs191343221, rs139815430, rs181981693, rs191359321, rs149865252, rs150371036, rs143829355, rs191372613, rs138452077, rs138452908, rs185386849, rs143842609, rs188237643, rs150393847, rs187773100, rs187775085, rs184966574, rs184977393, rs191427726, rs188275827, rs182035257, rs184996404, rs141453198, rs188284141, rs190995816, rs138488726, rs139848912, rs182512669, rs191445085, rs146642805, rs191006637, rs182521362, rs188309132, rs150023650, rs191085791, rs185460522, rs185466137, rs182175100, rs191091185, rs191109954, rs185493398, rs146761679, rs182203285, rs185502977, rs150107947, rs191122461, rs139722857, rs141521157, rs185512688, rs188369589, rs191126523, rs139884364, rs139732025, rs143623645, rs138334413, rs185538321, rs182251259, rs138341036, rs182626281, rs191206839, rs182313512, rs141315817, rs147236226, rs144030757, rs141338230, rs182655507, rs191614297, rs150639101, rs143731425, rs188153399, rs144066296, rs141603539, rs150324876, rs141375532, rs185622259, rs191640401, rs146970406, rs188513575, rs141629021, rs150341781, rs191351429, rs141401072, rs188532495, rs188248808, rs147057677, rs188544520, rs191692191, rs144131152, rs147074129, rs182496397, rs191429109, rs182500442, rs141673661, rs139846473, rs150446261, rs150785198, rs182820808, rs182520122, rs182835951, rs182529061, rs188657481, rs182852687, rs138621998, rs182529589, rs185798678, rs150473901, rs141757967, rs182553426, rs185815125, rs143943780, rs185496131, rs150902480, rs185498433, rs191884045, rs185502994, rs185503388, rs188365371, rs188776686, rs185517165, rs141530060, rs188383084, rs191914888, rs191918328, rs191918870, rs150560390, rs191920350, rs144365987, rs144372216, rs191935835, rs188403481, rs188811649, rs185898649, rs147221067, rs182626458, rs150991753, rs144016113, rs191958942, rs150590478, rs183013605, rs182641899, rs183026897, rs139927718, rs144435180, rs144435267, rs140119151, rs188473580, rs147697530, rs139930314, rs151064878, rs150652684, rs185979948, rs185640009, rs140151023, rs188519035, rs183095706, rs188522328, rs150690124, rs191679645, rs183115017, rs183125824, rs183133746, rs186044551, rs141940569, rs151168288, rs138746989, rs191681855, rs144136503, rs150725477, rs191708188, rs191711647, rs182806094, rs144573884, rs147831105, rs147833108, rs147430160, rs185756419, rs188657198, rs141742493, rs144270467, rs138636241, rs186110761, rs186125436, rs151258913, rs150885548, rs192222550, rs192233893, rs147939855, rs183284329, rs147539362, rs185839773, rs188756672, rs138823585, rs188769302, rs140057840, rs183353183, rs188780390, rs183367774, rs188784746, rs185874593, rs188790411, rs192366053, rs188810319, rs188814235, rs189287946, rs182991290, rs144392389, rs147640034, rs151008517, rs192402484, rs183036253, rs138700080, rs138700579, rs183064984, rs185993526, rs189320567, rs183090065, rs192417863, rs142157838, rs180836507, rs186006161, rs148149379, rs144500679, rs151120735, rs180884797, rs180886733, rs186060853, rs144552092, rs189017951, rs189022051, rs186460536, rs140492487, rs186461495, rs189023255, rs186466472, rs141954437, rs189522976, rs189523541, rs189049999, rs148313223, rs151210240, rs189054543, rs147849719, rs189539871, rs189064184, rs189068219, rs192210846, rs147956569, rs186209759, rs189569164, rs192674981, rs144747253, rs186238424, rs183351491, rs183367424, rs192699758, rs183370069, rs189262728, rs192363212, rs183403867, rs192726587, rs142134626, rs183711149, rs142138406, rs181081805, rs192738555, rs142140153, rs200131264, rs140380560, rs181094108, rs200134765, rs144841509, rs183732115, rs192406551, rs142150794, rs148096531, rs200162971, rs186321392, rs370110583, rs148456006, rs192433693, rs186364672, rs186633344, rs180802944, rs200178927, rs200194515, rs375200578, rs200182914, rs145193907, rs183502133, rs140445008, rs180893354, rs138915544, rs145244774, rs148241180, rs186442256, rs200240989, rs186465363, rs148278257, rs145257168, rs189524843, rs148315085, rs183628282, rs189533865, rs183640056, rs148556202, rs200292819, rs192655074, rs192658579, rs189564784, rs138962140, rs148362057, rs142347131, rs189586446, rs200341902, rs200063079, rs370018897, rs200099565, rs192906198, rs183704773, rs192723631, rs181075520, rs186767700, rs181079869, rs370059723, rs186771296, rs529190860, rs370067909, rs529209086, rs186784826, rs200394559, rs200399998, rs183730817, rs538838362, rs370082676, rs200408344, rs142400656, rs200411606, rs145182185, rs145187060, rs186806270, rs200172456, rs192975309, rs375204316, rs370455867, rs200449501, rs186648437, rs534019932, rs529286738, rs375210239, rs370472054, rs192801395, rs370474533, rs186654635, rs200213811, rs186674692, rs538940239, rs375250531, rs200482081, rs375566600, rs181175263, rs200486515, rs370211696, rs181183562, rs181186118, rs193052322, rs200518320, rs200258203, rs186875141, rs181200412, rs375314088, rs184015802, rs375635737, rs186886737, rs529393841, rs375684756, rs539081952, rs200296022, rs189773617, rs375344768, rs375717078, rs189783847, rs193147774, rs189793333, rs189802138, rs375383262, rs200341995, rs148603098, rs370331208, rs183883370, rs190038995, rs190041054, rs200356611, rs192916635, rs148622242, rs539165024, rs534237861, rs189833651, rs200381002, rs539201442, rs529545926, rs190079309, rs529224329, rs538840251, rs200677133, rs538845547, rs370750101, rs534286923, rs375828071, rs200417967, rs539238807, rs184127871, rs375484262, rs190100237, rs200702592, rs538865759, rs200441726, rs370458490, rs375873835, rs370471482, rs370474188, rs534038802, rs534350762, rs534357040, rs200464271, rs184169321, rs193007084, rs529641451, rs529320212, rs375570049, rs529339341, rs538978492, rs193043836, rs200774110, rs189961043, rs200780217, rs534113220, rs370879581, rs534409097, rs534414126, rs534415144, rs370562444, rs200579922, rs199528742, rs200815709, rs534171106, rs539098927, rs539117115, rs200830395, rs186937907, rs370939400, rs539140140, rs200617539, rs200619065, rs184228905, rs200835066, rs376036522, rs539143083, rs200849406, rs539479843, rs376051261, rs529755984, rs534486080, rs534488673, rs193152357, rs375749001, rs375763051, rs193166864, rs539520802, rs529783271, rs200878465, rs534232221, rs375776919, rs200884318, rs190061595, rs534278901, rs190082049, rs545837483, rs375825189, rs187135957, rs375828938, rs193224590, rs376111502, rs553880123, rs193232467, rs375856563, rs553890257, rs534545311, rs200709311, rs539583140, rs200720228, rs199625995, rs539285858, rs375886661, rs539314440, rs529638862, rs200757990, rs193290821, rs200764978, rs370859545, rs193298128, rs190162179, rs529872397, rs554016514, rs370874132, rs539661794, rs375980172, rs200809157, rs545964402, rs539677853, rs200826539, rs200972952, rs554071139, rs534656457, rs529727269, rs184226889, rs554100480, rs376022705, rs200831251, rs200999865, rs201000497, rs529730407, rs200843960, rs184246546, rs190358218, rs554163756, rs554165274, rs199576878, rs539500156, rs376288233, rs199589622, rs184260785, rs371207844, rs200882280, rs199599557, rs199756028, rs529983093, rs200885240, rs187133567, rs563464573, rs201061055, rs539547053, rs554273987, rs529802379, rs199609865, rs553889410, rs546154866, rs553889944, rs534551405, rs553911796, rs371042731, rs554309833, rs554312712, rs199784484, rs201087484, rs371264016, rs199791955, rs563543796, rs554341821, rs546194264, rs371271639, rs545893207, rs539907191, rs546211175, rs539907650, rs554376047, rs534785673, rs200925482, rs201111027, rs546225573, rs190283527, rs553954986, rs199824489, rs200939963, rs199828294, rs539633485, rs534590465, rs530084774, rs199836776, rs553992440, rs200946565, rs376437229, rs534834256, rs545955340, rs529878459, rs534839750, rs539669267, rs563692075, rs546307681, rs199679924, rs554081720, rs534850887, rs554088921, rs540043962, rs554092522, rs190336684, rs199879584, rs530137975, rs200995410, rs530143022, rs371164212, rs190349718, rs546362979, rs199717009, rs371397880, rs540082625, rs201198963, rs201021546, rs563799556, rs199737519, rs371414170, rs554199061, rs199746311, rs546391192, rs190379146, rs199753578, rs201051190, rs199757256, rs199915769, rs546428044, rs554663323, rs199924841, rs540148616, rs563477777, rs199933920, rs546146748, rs563898086, rs201243874, rs546456054, rs199940586, rs530215503, rs563913729, rs530218681, rs376579866, rs199948709, rs540192719, rs540198060, rs554750370, rs563492226, rs554287627, rs546498422, rs546158464, rs540216332, rs554299241, rs199968973, rs546516362, rs563983733, rs199780289, rs199780984, rs371286659, rs371523166, rs530267604, rs199987389, rs540258346, rs534786295, rs546227682, rs535009588, rs371537833, rs546570808, rs546572548, rs534792758, rs554861011, rs530289862, rs539955067, rs199832245, rs199832681, rs199841742, rs554463637, rs535055981, rs564125461, rs200028908, rs546625033, rs199848155, rs376692400, rs564139470, rs199850424, rs201155458, rs554499889, rs535082824, rs554501599, rs371367087, rs563737735, rs200056934, rs564203583, rs546340639, rs371630270, rs540400302, rs376746720, rs201185327, rs546352773, rs575423992, rs376493135, rs546717270, rs371397187, rs540431428, rs534892966, rs201205411, rs199903431, rs376515297, rs563817371, rs563824187, rs546746556, rs555098627, rs575492002, rs201217172, rs376529993, rs554686400, rs546760948, rs534939379, rs563953797, rs540206408, rs546500427, rs540485824, rs376608116, rs554799633, rs540505612, rs201445594, rs546799753, rs540240449, rs534999520, rs540519101, rs564030716, rs376835362, rs530454237, rs564030746, rs199998975, rs200004737, rs564394299, rs540551673, rs575674513, rs564399141, rs564446433, rs200011236, rs575695879, rs530483113, rs530485751, rs575707171, rs564466723, rs376885423, rs535039496, rs546880794, rs371565974, rs546882633, rs371773562, rs535234661, rs540598706, rs564107843, rs201343843, rs201354058, rs201503351, rs530342843, rs546907614, rs376908183, rs201510411, rs554978785, rs201511761, rs200048101, rs546921591, rs530350892, rs376922975, rs564200680, rs200060978, rs201533181, rs575403459, rs564241971, rs564580989, rs546961299, rs201544671, rs201545926, rs371836327, rs540688834, rs201398365, rs575434258, rs564263518, rs564274418, rs376775745, rs575466805, rs555444508, rs201414746, rs546745027, rs564310081, rs376792891, rs564315036, rs547017479, rs530416775, rs564331757, rs547021107, rs564332268, rs564662103, rs540733381, rs555135086, rs555471824, rs576009530, rs530597787, rs576019908, rs555139503, rs201589695, rs546790645, rs576055160, rs564376709, rs564714000, rs201599943, rs530619739, rs547065965, rs575600523, rs540522467, rs540547244, rs547082685, rs564445595, rs540567098, rs540796514, rs371731981, rs564769026, rs546879622, rs377073478, rs540589456, rs555621992, rs371916205, rs371958712, rs530634413, rs575756239, rs376897349, rs371780831, rs376904842, rs535249716, rs575804340, rs555336411, rs540652005, rs530685640, rs376937738, rs555659985, rs201659566, rs530547787, rs575882807, rs201664439, rs564870320, rs376965890, rs564871823, rs546993077, rs575943952, rs201560701, rs540907392, rs564896638, rs564896690, rs547000677, rs564899870, rs201563763, rs576373898, rs564640008, rs555445641, rs575973973, rs372028184, rs371863491, rs555773796, rs564960625, rs547253736, rs576455029, rs540974086, rs564986496, rs564993510, rs201726729, rs371864190, rs565010528, rs540730019, rs201574893, rs376994924, rs530783315, rs201577842, rs201741634, rs201743233, rs547309884, rs371884028, rs372088334, rs377222716, rs576572380, rs576041557, rs547054615, rs201761066, rs377231210, rs576600072, rs576089157, rs530626933, rs541061398, rs530815395, rs576098220, rs565110303, rs540810897, rs555612139, rs541084553, rs576662260, rs547128261, rs540853945, rs555633602, rs377085474, rs547403854, rs565167501, rs530849811, rs576712624, rs547415198, rs201649913, rs201651716, rs377093160, rs535596388, rs576773731, rs576676610, rs535558092, rs565234556, rs377328308, rs555955176, rs565256471, rs556091995, rs372131207, rs201845924, rs555645605, rs541215463, rs564833136, rs565311283, rs565318120, rs540868515, rs576946641, rs556156424, rs547539536, rs201883775, rs535414368, rs372262107, rs530959005, rs540871938, rs577021824, rs535419397, rs201895529, rs540879571, rs372269123, rs377116511, rs547186293, rs565405762, rs547588654, rs201905108, rs556236282, rs201905758, rs547191791, rs540903705, rs547201834, rs530979178, rs372002155, rs576377214, rs555741423, rs577086434, rs201915876, rs530989045, rs540941092, rs556278477, rs535735811, rs201707595, rs576479846, rs541356065, rs541358959, rs535499788, rs541362812, rs565031158, rs535511711, rs577214491, rs372339994, rs377206205, rs576544612, rs377226193, rs576585621, rs541054278, rs577266682, rs565097315, rs565571242, rs577289107, rs556405965, rs576629767, rs535795174, rs530825627, rs565155125, rs565186443, rs201992546, rs541131401, rs377540035, rs377540898, rs541131406, rs565224250, rs201821518, rs541464325, rs577369845, rs565254553, rs577404457, rs372203675, rs565602281, rs202014643, rs576881042, rs577440102, rs547742253, rs577443766, rs531116715, rs377543079, rs565709853, rs201999985, rs377592540, rs541216093, rs201867764, rs565371438, rs372263773, rs547573283, rs201896555, rs535696383, rs201899627, rs530977363, rs577068583, rs201908866, rs547600407, rs547600820, rs535712483, rs556270749, rs541350117, rs577567218, rs577154533, rs565779439, rs541577543, rs577175836, rs531022872, rs565800474, rs565519424, rs541591158, rs547675018, rs541594618, rs565809092, rs372495273, rs541395767, rs202083986, rs556650900, rs565547663, rs577251799, rs556665730, rs556373614, rs531050542, rs565585913, rs531203453, rs565871418, rs535797353, rs202109432, rs577720248, rs201987450, rs531083937, rs577393911, rs531100303, rs556716582, rs577747466, rs556487424, rs372559804, rs556713829, rs531103846, rs565682322, rs372563835, rs577815172, rs377588911, rs565947211, rs547813798, rs531250791, rs556789899, rs531125112, rs541713728, rs556819410, rs377754745, rs556713324, rs547819277, rs536000213, rs377597385, rs202165845, rs556543920, rs535860380, rs556549617, rs577508369, rs556552102, rs548057554, rs565736915, rs202180059, rs556878947, rs547836679, rs202051580, rs577538470, rs577539276, rs531148427, rs556584085, rs531302114, rs202061011, rs535883810, rs556612694, rs531317317, rs202071016, rs372490157, rs372654175, rs556940143, rs372655989, rs541594525, rs578059299, rs541831570, rs577625085, rs547898574, rs372511122, rs202219028, rs531188532, rs547913013, rs541630786, rs547938227, rs578134604, rs541870309, rs556706372, rs202110802, rs372557663, rs547975937, rs566204756, rs566207903, rs577796497, rs556764057, rs557048933, rs202241586, rs531379120, rs557050535, rs541923828, rs556774205, rs578243189, rs541702079, rs535980549, rs531270141, rs535997775, rs566269762, rs556841303, rs557109946, rs745311902, rs548256739, rs556848020, rs548043362, rs536155895, rs566022284, rs577936356, rs541985091, rs548053319, rs556871781, rs536168223, rs566049151, rs577967498, rs566340038, rs386391721, rs386391722, rs557188530, rs367584747, rs386391723, rs566366442, rs536028182, rs542030965, rs578005069, rs566085715, rs566086387, rs578024455, rs367621683, rs548346140, rs372833423, rs548105826, rs202211195, rs745531940, rs202215137, rs578072210, rs372665054, rs531338785, rs536243045, rs566133697, rs578090160, rs367666265, rs578114636, rs548158077, rs566180671, rs397765197, rs536089884, rs557356456, rs397767714, rs367683945, rs566528668, rs745659906, rs267598976, rs557071588, rs267598977, rs367701477, rs566564807, rs536281976, rs578242489, rs566583346, rs548214486, rs548476797, rs536129992, rs548482202, rs566262563, rs566594213, rs267607030, rs372744611, rs557461504, rs745754029, rs566617243, rs566617297, rs548258391, rs566310144, rs548519839, rs745338187, rs536158076, rs548274093, rs745823712, rs536163412, rs397868358, rs548542674, rs536168659, rs745839147, rs566338405, rs566348964, rs557535791, rs548558816, rs548565032, rs745383244, rs397870091, rs548565940, rs542287393, rs566709971, rs372990045, rs557204387, rs745418676, rs566409045, rs566730224, rs566752170, rs566753733, rs372818817, rs397722222, rs745983399, rs367830408, rs745480989, rs566793485, rs397734324, rs548645786, rs557669888, rs745516750, rs548657650, rs548381702, rs745552432, rs536425753, rs397973279, rs746070730, rs548387911, rs557708733, rs372854250, rs745569838, rs548698515, rs566482323, rs557734401, rs746118213, rs542420738, rs367667669, rs397986566, rs566902157, rs531528009, rs548736753, rs566500747, rs542456172, rs746187360, rs367671512, rs566932278, rs745660727, rs367697326, rs548464529, rs531756169, rs542471936, rs566573122, rs566962886, rs542498214, rs566982218, rs542504451, rs557806739, rs398090827, rs746306232, rs536489917, rs531803128, rs745714010, rs367720972, rs557918693, rs746350953, rs745725339, rs367991453, rs527241020, rs531579666, rs746381295, rs542208653, rs397818828, rs746391927, rs557954773, rs531600512, rs566644132, rs548866946, rs536555587, rs566656331, rs372959324, rs548538509, rs567102431, rs745838757, rs397868838, rs746437505, rs397868962, rs548885146, rs531845059, rs536570765, rs372983721, rs557571631, rs566719571, rs536584686, rs566723075, rs542325703, rs542643487, rs368055368, rs373019820, rs567192923, rs548936551, rs542349880, rs558065104, rs542355012, rs368062692, rs536415135, rs397963856, rs746552388, rs557690548, rs542394071, rs746083843, rs548693261, rs557732835, rs746143575, rs542699414, rs558122779, rs567298923, rs536465674, rs558134318, rs531746406, rs527346644, rs548743673, rs368107300, rs367917548, rs746198188, rs557871766, rs567022998, rs567363028, rs373168195, rs567043047, rs567054046, rs558207456, rs542763237, rs746378441, rs536545503, rs542568822, rs548865256, rs368147111, rs542580556, rs558228752, rs536555646, rs746772302, rs536557590, rs531975462, rs746796860, rs527408032, rs746420496, rs536564089, rs368176642, rs558272974, rs746431232, rs531844054, rs527275962, rs746843910, rs567526414, rs542614723, rs549120414, rs549124141, rs536578689, rs549140206, rs567586614, rs536744845, rs558044120, rs746516190, rs558055629, rs746920567, rs558060550, rs368061706, rs527461217, rs567208316, rs531886773, rs746554596, rs567220976, rs542895321, rs746974389, rs567222661, rs549185419, rs567237436, rs527336026, rs527483460, rs558121403, rs548993925, rs567691347, rs747002615, rs548995543, rs746650412, rs368271911, rs567723777, rs747040934, rs747050192, rs746670993, rs567347819, rs527512680, rs531938194, rs549242146, rs549032856, rs567373871, rs567394422, rs368307024, rs542980503, rs558508221, rs536676061, rs536681562, rs558516052, rs549052565, rs368145556, rs532090630, rs527554992, rs532120905, rs558490145, rs747176695, rs542991566, rs542774236, rs368150079, rs373340022, rs558242385, rs549357789, rs531980410, rs368389084, rs746808580, rs549368350, rs567506427, rs531991551, rs536910845, rs549105394, rs746848184, rs373384143, rs549407905, rs558344252, rs527453833, rs549417854, rs746919102, rs746928276, rs527655882, rs368229380, rs558364672, rs549168229, rs368463219, rs568161057, rs558762757, rs532232329, rs549168547, rs747470520, rs549464271, rs543190810, rs543192154, rs368241422, rs536968067, rs747507965, rs558804203, rs542903509, rs747524681, rs567666371, rs558400652, rs549194158, rs527487277, rs368267915, rs536991033, rs568290255, rs558428181, rs567744716, rs527721202, rs568321346, rs568324171, rs568330046, rs567746937, rs568347691, rs747644321, rs747646048, rs567759326, rs747078793, rs536831479, rs568368464, rs558924666, rs543302057, rs543307320, rs747708818, rs558953446, rs568439076, rs532106809, rs558517679, rs558548847, rs747224561, rs568476272, rs567841142, rs549626904, rs373748468, rs747772882, rs747777569, rs559008851, rs549332923, rs373735201, rs747760347, rs568467648, rs568540915, rs568478645, rs568552353, rs368374445, rs747265095, rs567978316, rs559065366, rs527824027, rs537109464, rs747287657, rs747918167, rs536895056, rs373815330, rs536905377, rs537128261, rs558672062, rs568679804, rs537140055, rs747362082, rs543122161, rs558701088, rs747382624, rs373841126, rs532429751, rs568724063, rs543132278, rs747426187, rs543154656, rs373616597, rs747448727, rs558755199, rs543176875, rs558793028, rs549483878, rs559205579, rs549801876, rs748064481, rs549805500, rs568786830, rs368724653, rs368741155, rs558812967, rs373650798, rs558827971, rs527935102, rs549505744, rs532266308, rs568910791, rs543588977, rs568921105, rs543252094, rs568938831, rs568308434, rs748230779, rs558889724, rs543276363, rs532518466, rs549553842, rs558900091, rs568478922, rs373953968, rs549933491, rs559388880, rs569021337, rs748301976, rs527792590, rs748304870, rs537274423, rs527797934, rs549957716, rs559020013, rs747831682, rs747839515, rs537094901, rs568565984, rs549993366, rs373786499, rs568616456, rs528024377, rs569138531, rs373808223, rs748419478, rs568648416, rs747947163, rs543458934, rs527866121, rs748000776, rs748452908, rs543474534, rs559511141, rs532596683, rs528051938, rs748032198, rs559524225, rs559189600, rs748504526, rs537164960, rs569247301, rs748039029, rs549789421, rs559564579, rs543501994, rs748048145, rs748564719, rs368926174, rs532635443, rs373862049, rs559205490, rs532651681, rs368949323, rs374099497, rs543549351, rs537201581, rs550141100, rs537202219, rs532674344, rs543574164, rs748190208, rs559321177, rs559677369, rs569424535, rs748690640, rs748695381, rs527959809, rs748236906, rs537243887, rs568970879, rs559373028, rs373953011, rs569027161, rs543882002, rs559723934, rs549952543, rs528001989, rs748754609, rs569502538, rs532712684, rs374154008, rs369022060, rs569525422, rs543668808, rs550218083, rs369031999, rs532562751, rs537295453, rs543930117, rs537468875, rs550244319, rs569098216, rs550247150, rs569123332, rs748398622, rs569610503, rs569138600, rs559826745, rs559831361, rs537315654, rs374011315, rs569152152, rs559871284, rs550298627, rs550018415, rs374021078, rs748455811, rs369107141, rs569197685, rs569789352, rs544062895, rs550041205, rs749055063, rs544064839, rs569814685, rs532613900, rs537352949, rs550065962, rs569844606, rs559995442, rs569277903, rs550412301, rs569291008, rs368934346, rs569896484, rs550421090, rs748602707, rs374102129, rs560036890, rs528121884, rs537409772, rs569406301, rs749187435, rs560050695, rs374116302, rs749215366, rs560073328, rs749217434, rs569413716, rs569435862, rs537425379, rs559701154, rs550504055, rs537429508, rs537648288, rs528365663, rs748720721, rs559707544, rs748725716, rs570053547, rs748745862, rs528373215, rs537657709, rs749311576, rs569486858, rs544215781, rs374387803, rs748789887, rs369261656, rs544222244, rs559774900, rs369037062, rs528392678, rs569589072, rs569594721, rs537484448, rs560194858, rs532943697, rs528207220, rs550610763, rs570175462, rs543970760, rs532756083, rs749422762, rs537706167, rs550630579, rs528430659, rs569673848, rs570223084, rs544008440, rs748956951, rs532972999, rs560270291, rs749479220, rs560277925, rs559882854, rs749000031, rs544323417, rs570287651, rs749525560, rs528461391, rs537558317, rs749079120, rs374481593, rs550724860, rs560344389, rs559975872, rs374497861, rs569835399, rs749602473, rs749608721, rs570379112, rs749616223, rs570383918, rs560388069, rs550404028, rs550788771, rs532851603, rs532852070, rs528314905, rs570419018, rs528315588, rs374522881, rs569919976, rs550435904, rs570456628, rs569926252, rs550450442, rs749695781, rs749701713, rs374544338, rs528533074, rs537818590, rs570492575, rs570495057, rs544454714, rs374350913, rs570000771, rs570005998, rs570551342, rs369229821, rs749284610, rs570558380, rs528366547, rs550901951, rs550527209, rs570048995, rs550533340, rs570063206, rs369464511, rs528383682, rs374397762, rs550927757, rs550923680, rs560539816, rs533107673, rs374594002, rs369476119, rs749864558, rs570646108, rs550966261, rs749881351, rs749897918, rs550925375, rs544544030, rs544231457, rs560608042, rs560181527, rs544551194, rs369520775, rs533153225, rs528632986, rs749364100, rs544577577, rs369534920, rs570119696, rs570782066, rs528411030, rs550621249, rs551063575, rs750002442, rs750005785, rs528650251, rs369296369, rs560255202, rs374670592, rs551081825, rs570227654, rs570232101, rs550676640, rs560705198, rs551103406, rs570060579, rs570253110, rs570861231, rs551126930, rs560742915, rs532994198, rs537750141, rs528481236, rs374500828, rs528693904, rs544387925, rs528695618, rs544671979, rs749640667, rs528701463, rs570957540, rs528504065, rs528504422, rs560405294, rs570985462, rs560819326, rs560408978, rs533248873, rs544410928, rs570467358, rs571031386, rs544422821, rs571046788, rs550875084, rs544456517, rs533083149, rs528558257, rs570555980, rs749782980, rs571112937, rs533289922, rs560511642, rs533297953, rs528567800, rs544487770, rs750377110, rs369709511, rs750395605, rs560523856, rs570685646, rs560602815, rs533104605, rs571201597, rs369722062, rs538095397, rs537898453, rs560644731, rs533167279, rs560669576, rs551401679, rs369545306, rs561042263, rs551429062, rs750017693, rs369556343, rs551090369, rs538124443, rs750042378, rs537945859, rs374872804, rs571350458, rs561086455, rs571361273, rs570859811, rs570896555, rs570898206, rs544911099, rs561103484, rs750110593, rs544921736, rs528872305, rs571410824, rs571416933, rs369592808, rs528882230, rs551531848, rs551164285, rs528891024, rs533405417, rs750148529, rs571464240, rs750175883, rs551569090, rs560811710, rs544697883, rs571001720, rs544980017, rs571007860, rs551236739, rs551249244, rs528924602, rs571065554, rs528745212, rs750724319, rs538210953, rs528933846, rs571071311, rs750755032, rs528942614, rs538036504, rs538040234, rs544760124, rs560927301, rs544802212, rs538235148, rs528956488, rs551342807, rs533481144, rs369899370, rs551359194, rs369900308, rs750399158, rs538259887, rs528795367, rs750864433, rs750411662, rs533498494, rs560998810, rs571707506, rs561331700, rs375028919, rs545103329, rs571703952, rs544837618, rs528807734, rs551400406, rs571269005, rs544875089, rs529020508, rs533357560, rs750951154, rs551440261, rs750514774, rs544886311, rs551792787, rs561404804, rs571366310, rs528855590, rs751001567, rs375069289, rs533379792, rs571842712, rs533382711, rs561137186, rs571879284, rs750631806, rs529077450, rs561470191, rs750638359, rs529093387, rs551558117, rs551573774, rs551579214, rs571500446, rs561525428, rs545229175, rs751136819, rs551581886, rs750707641, rs571528077, rs755813688, rs561214522, rs572015044, rs571536730, rs369860008, rs528947505, rs551963416, rs538225517, rs545277826, rs533634090, rs561260903, rs571600152, rs369874176, rs571638665, rs552017588, rs571666279, rs571668997, rs369907063, rs769057914, rs552049341, rs769065818, rs751325083, rs561669214, rs552061128, rs572187861, rs756005334, rs538475444, rs756013985, rs545099670, rs552106230, rs545375585, rs572237867, rs561726025, rs769150127, rs529011948, rs538288286, rs571755014, rs571757393, rs538515826, rs545115612, rs533712836, rs545115642, rs750944314, rs529029702, rs571778387, rs529035618, rs552177570, rs571826748, rs751000526, rs369968332, rs571851662, rs545431594, rs561799159, rs561460464, rs571880265, rs769270578, rs533571445, rs571940318, rs756189754, rs545217019, rs571959447, rs751128080, rs538381958, rs755804903, rs751159961, rs751175785, rs572018867, rs756228072, rs751582483, rs561574977, rs561576248, rs572437382, rs755851030, rs561611663, rs552286628, rs545506688, rs768991354, rs769402083, rs769406063, rs572087546, rs538428981, rs769026589, rs755939083, rs572579811, rs769491361, rs561982435, rs769046166, rs751371429, rs572259896, rs545578378, rs756446498, rs751798524, rs572656276, rs756457749, rs769554090, rs538674345, rs751813574, rs552419780, rs756076130, rs552432031, rs769194199, rs533853260, rs572717577, rs769195919, rs572295505, rs533714676, rs538700995, rs545631150, rs538526606, rs572321690, rs572759437, rs538715990, rs562093903, rs552491193, rs552493086, rs751920813, rs572323525, rs552522135, rs769705492, rs751482341, rs572334430, rs751492391, rs545682563, rs751495665, rs538752299, rs545696456, rs538535248, rs572354221, rs751523153, rs545446264, rs572377516, rs533919054, rs572892333, rs769771450, rs769774967, rs572382379, rs572388571, rs756700849, rs756704425, rs769807240, rs769295468, rs572950216, rs562222303, rs751550702, rs752097894, rs769296900, rs572978709, rs572982359, rs561835001, rs552229556, rs552242552, rs533760063, rs552650520, rs752133481, rs561858372, rs756247571, rs769912734, rs756277853, rs545508686, rs561928325, rs572544925, rs561951163, rs756369671, rs752191138, rs769511874, rs751770785, rs769520412, rs756476767, rs545617350, rs573120275, rs552452362, rs552743787, rs552722759, rs573125010, rs572720574, rs752267943, rs572723257, rs562364859, rs769633498, rs752289745, rs770063371, rs756983343, rs552799307, rs756541837, rs756588238, rs752355486, rs770120624, rs572827353, rs751960880, rs552847137, rs573278742, rs769713298, rs752418228, rs573311661, rs533903238, rs552555197, rs562163326, rs573336871, rs770205263, rs562492571, rs552901035, rs573360915, rs770226861, rs552927404, rs752501530, rs752008244, rs756662298, rs752010591, rs752027589, rs562558634, rs573456983, rs769784952, rs752598240, rs572946713, rs756749599, rs756758706, rs752107556, rs769861427, rs562628042, rs573532135, rs752123654, rs573539819, rs752651234, rs757322465, rs545769534, rs757324658, rs573014318, rs752159218, rs752669367, rs545789688, rs562288190, rs573583431, rs752694131, rs553077185, rs752705175, rs562290070, rs573057895, rs756846139, rs752187308, rs757406912, rs573077799, rs552710847, rs757431594, rs573668899, rs553131814, rs562733566, rs562322012, rs573698013, rs770570377, rs769977143, rs752262387, rs752842135, rs553198489, rs562795927, rs573769337, rs752265531, rs770014639, rs757542280, rs573778414, rs573160530, rs573173020, rs756996519, rs757574398, rs573226807, rs573830638, rs573832648, rs770130183, rs770143495, rs770714259, rs752395219, rs757620158, rs562472371, rs757091887, rs757651862, rs573329574, rs552932842, rs757678036, rs562906731, rs573398771, rs573931855, rs757698701, rs573423419, rs757196334, rs573956248, rs562590653, rs770844073, rs753073195, rs757264923, rs770368521, rs562966673, rs553375250, rs572286231, rs562624182, rs553028786, rs562631637, rs553396451, rs757816346, rs752659859, rs770424435, rs753158893, rs753161012, rs553429432, rs757326234, rs562658586, rs757848676, rs563030100, rs757851276, rs770440360, rs553444080, rs562685659, rs770998439, rs757903328, rs752715463, rs753243305, rs574158047, rs753248999, rs573615359, rs771049218, rs553520048, rs574218458, rs574218497, rs770484072, rs770507859, rs757415695, rs573692993, rs771127117, rs753348681, rs770572267, rs574279980, rs573729847, rs553217886, rs752874223, rs574313437, rs770646119, rs753375127, rs553594673, rs753413529, rs563204921, rs563204956, rs573793230, rs553615720, rs770669377, rs752915464, rs752935458, rs771254688, rs563250976, rs752936829, rs573845641, rs758171359, rs553671701, rs757627939, rs770755089, rs770761836, rs573905888, rs758213818, rs574458879, rs758231448, rs770785487, rs563313026, rs758251421, rs758252419, rs573944942, rs753048798, rs771377765, rs563340232, rs553350853, rs758286245, rs562957866, rs553362365, rs757786023, rs574020661, rs753630953, rs562989702, rs574575080, rs753648561, rs753119257, rs753668162, rs753149666, rs563015753, rs753169837, rs553433381, rs770963601, rs574621082, rs753732662, rs758421005, rs574670231, rs757870156, rs771562041, rs574145206, rs574724729, rs757927255, rs553537463, rs771111770, rs574251637, rs553550103, rs563161459, rs758527549, rs574771040, rs753843081, rs553570026, rs771649415, rs574292008, rs771662229, rs574805977, rs574854330, rs771738593, rs563201986, rs758651382, rs574315059, rs758656020, rs574340577, rs758660161, rs771774637, rs758691949, rs758107372, rs754017346, rs771227297, rs563235099, rs553661695, rs754045274, rs563260674, rs754055297, rs563269397, rs553682936, rs574438316, rs771304275, rs758800428, rs753559306, rs771919739, rs753582578, rs754141945, rs575081551, rs563336388, rs575092590, rs753600502, rs575125159, rs771392468, rs563351273, rs758888190, rs563353671, rs758905037, rs771413333, rs553772622, rs574587211, rs753682189, rs758373659, rs772039702, rs772039784, rs772048626, rs754275081, rs771477905, rs753690596, rs553815137, rs575278958, rs574681748, rs575303100, rs771582810, rs758485743, rs759087854, rs575348590, rs753812341, rs759111100, rs772225059, rs758499442, rs754462186, rs754476252, rs574742878, rs754490813, rs772285262, rs753828829, rs574761563,
rs772336893, rs754543076, rs759290654, rs772395366, rs753849639, rs754638250, rs758555473, rs759384662, rs574887579, rs754694440, rs772505511, rs754710057, rs753978827, rs771768782, rs772542224, rs772565872, rs574947376, rs759493094, rs771816020, rs574962188, rs758720517, rs754046765, rs772538411, rs754056327, rs759582553, rs754072901, rs759604608, rs759618021, rs759618971, rs772713563, rs754073647, rs754934055, rs754977237, rs772800001, rs758784984, rs754113212, rs575064964, rs575092333, rs771950039, rs575127361, rs771984656, rs771998562, rs772005602, rs759809047, rs772905789, rs575158631, rs755129606, rs754241027, rs755139637, rs754241912, rs759868988, rs575188566, rs755204073, rs773012423, rs773015695, rs773030286, rs575222561, rs759000378, rs575270437, rs772133229, rs759054169, rs760019571, rs575323599, rs772196281, rs755344662, rs755345735, rs759150088, rs773161532, rs755360952, rs755361509, rs772283807, rs760088897, rs773197006, rs773259205, rs760189302, rs755471441, rs755501706, rs754512913, rs760244093, rs755553046, rs772335325, rs759300259, rs772449743, rs773425925, rs772489586, rs754719129, rs755653914, rs755666694, rs760410743, rs759482720, rs759520309, rs754870625, rs760471093, rs759523063, rs754822550, rs773686703, rs754840578, rs760600919, rs760603637, rs772672495, rs754892941, rs760523838, rs760451171, rs755736948, rs760557658, rs760816228, rs772714587, rs755000613, rs772804611, rs755017523, rs759736603, rs759736945, rs760912489, rs774006498, rs772843217, rs759766086, rs755067851, rs759784688, rs761013330, rs772909429, rs772930184, rs761116601, rs761152276, rs774249327, rs774251259, rs774274995, rs772944744, rs761216742, rs774309167, rs772964132, rs761267824, rs761373885, rs759949565, rs755275181, rs774519927, rs774522732, rs761441210, rs761463732, rs773084045, rs773099131, rs773104432, rs760030368, rs774666634, rs761564783, rs761565126, rs755324498, rs773159916, rs761601211, rs755370020, rs761671328, rs774795813, rs774799502, rs760228901, rs774812992, rs774858304, rs761769631, rs755586452, rs761781232, rs774899950, rs773396301, rs760333909, rs755619723, rs774976082, rs761920258, rs761927300, rs761950663, rs773446299, rs761963623, rs775079409, rs755705775, rs773689919, rs760624162, rs760699862, rs762086202, rs775205757, rs762111294, rs762125145, rs760733738, rs773860024, rs775323392, rs762225419, rs775369857, rs775376322, rs773919023, rs773782386, rs760694869, rs775387692, rs773967655, rs760882331, rs762340832, rs762148321, rs762202141, rs775464792, rs775131844, rs762435356, rs775544399, rs762034007, rs762510204, rs775614853, rs775627209, rs773976748, rs760891383, rs760906241, rs774029965, rs775822699, rs762720619, rs774047193, rs774053322, rs762804252, rs774058465, rs774129861, rs761104208, rs762966087, rs762968069, rs776089462, rs761185751, rs774332033, rs774469859, rs776158237, rs774482073, rs774589810, rs761511663, rs763179120, rs761511750, rs774646303, rs761588559, rs774694132, rs774728176, rs761697288, rs774886139, rs774922349, rs761826946, rs761845760, rs775063793, rs762003012, rs776637872, rs776654464, rs763546628, rs775110547, rs762276860, rs775383881, rs775461240, rs762422181, rs776740578, rs763649134, rs775386066, rs762309744, rs762328054, rs762349561, rs763826888, rs776958522, rs763851219, rs763608389, rs776992703, rs763887905, rs776685090, rs763905132, rs763962939, rs763974094, rs777096875, rs764029915, rs763580952, rs775580427, rs762627922, rs777288188, rs762666941, rs762675794, rs775794317, rs762726532, rs762730738, rs762889511, rs762892329, rs762959657, rs763002281, rs763002290, rs763012243, rs776218442, rs777563631, rs776244370, rs777622383, rs776251366, rs776332292, rs763230781, rs776360258, rs776427552, rs764653324, rs776476300, rs763360058, rs763363216, rs776553236, rs763457677, rs777864926, rs763480814, rs763480911, rs776628475, rs763552752, rs763566743, rs778010014, rs778022974, rs778036245, rs763698303, rs776874241, rs777012344, rs763688323, rs778143440, rs777215702, rs778289549, rs778300575, rs764096123, rs776939122, rs776981873, rs778119782, rs778380666, rs778267601, rs765112370, rs778321318, rs778494297, rs765311513, rs764145516, rs777290815, rs765318979, rs765320933, rs764873930, rs764888631, rs778333649, rs778374010, rs764194425, rs778674007, rs777339467, rs777382966, rs777418612, rs777478358, rs765540232, rs764346157, rs764347894, rs778800909, rs764349631, rs764377819, rs764399440, rs778929063, rs779079123, rs777546243, rs764445619, rs765838143, rs779164966, rs777646023, rs779192695, rs764496311, rs777703989, rs777740982, rs777812604, rs777829093, rs764661916, rs777840632, rs779461736, rs777844017, rs777855721, rs766045094, rs766058889, rs764699511, rs764719051, rs764746314, rs764794225, rs779681069, rs777969265, rs779840641, rs779874157, rs778055850, rs778396766, rs779957394, rs766239824, rs780023870, rs780043145, rs766263796, rs766274346, rs778441261, rs765258572, rs780109322, rs778501127, rs765316534, rs766324084, rs778543495, rs765369653, rs778602129, rs766393434, rs780316047, rs765423637, rs778611965, rs780347157, rs765492974, rs765497371, rs778714853, rs780447105, rs765533323, rs766481843, rs780503041, rs780639638, rs765541870, rs780693341, rs778736307, rs765643844, rs765653200, rs765673912, rs765800389, rs766622658, rs780798844, rs779132370, rs766649583, rs779175706, rs779230028, rs779282960, rs779344629, rs779375751, rs765948436, rs779425422, rs781124123, rs779450397, rs765993652, rs766010851, rs766066655, rs766071038, rs779649545, rs779679057, rs779738791, rs766206300, rs766879944, rs779928230, rs766901141, rs766933679, rs780083168, rs766940667, rs766287305, rs766299085, rs766300702, rs781535786, rs781539021, rs781551678, rs780193488, rs780222163, rs780296350, rs766400518, rs796125137, rs767194024, rs780344643, rs767261742, rs780357335, rs766453651, rs766456874, rs780494441, rs766560176, rs796454833, rs767330330, rs766575026, rs780717433, rs796834572, rs780751522, rs796879015, rs796895878, rs796908878, rs796943897, rs780779741, rs767568953, rs767585211, rs767665163, rs780791041, rs780805821, rs767821897, rs767874262, rs780879054, rs767995767, rs768064437, rs766687711, rs766688014, rs766704428, rs768290765, rs781060177, rs781072045, rs768466223, rs781072572, rs781158522, rs781159679, rs768587771, rs768603693, rs768623038, rs768653386, rs768702122, rs768711176, rs768744959, rs768781393, rs781188766, rs768844255, rs781231699, rs768884828, rs768886558, rs781253062, rs781284676, rs766863424, rs781317195, rs781327688, rs781361862, rs781448754, rs781467412, rs766956430, rs781531817, rs767039336, rs767055311, rs781777533, rs767184929, rs796249942, rs796309254, rs767265990, rs796349008, rs796352290, rs796380704, rs796730002, rs796797940, rs796870168, rs796981058, rs767788312, rs767804500, rs767905631, rs768152740, rs768239772, rs768260693, rs768385834, rs768416620, rs768531332, rs768574136, rs768585281, rs768804885, and rs768853312.

In one example, the guide RNA used in the present disclosure may comprise at least one 20 nucleotide (nt) target nucleic acid sequence listed in Table 5. Provided in Table 5 are the gene symbol and the sequence identifier of the gene (Gene SEQ ID NO), the gene sequence including 1-5 kilobase pairs upstream and/or downstream of the target gene (Extended Gene SEQ ID NO), and the 20 nt target nucleic acid sequence (20 nt Target Sequence SEQ ID NO). In the sequence listing the respective target gene, the strand for targeting the gene (noted by a (+) strand or (−) strand in the sequence listing), the associated PAM type and the PAM sequence are described for each of the 20 nt target nucleic acid sequences (SEQ ID NO: 5305-125469). It is understood in the art that the spacer sequence, where "T" is "U," may be an RNA sequence corresponding to the 20 nt sequences listed in Table 5.

TABLE 5

Nucleic Acid Sequences

| Gene Symbol | Gene SEQ ID NO | Extended Gene SEQ ID NO | 20 nt Target Sequence SEQ ID NO |
|---|---|---|---|
| SCN9A | 5303 | 5304 | 5305-125469 |

In one example the guide RNA used in the present disclosure may comprise at least one spacer sequence that, where "T" is "U," may be an RNA sequence corresponding to a 20 nucleotide (nt) target sequence such as, but not limited to, any of SEQ ID NO: 5305-125469.

In one example, the guide RNA used in the present disclosure may comprise at least one spacer sequence which, where "T" is "U," is an RNA sequence corresponding to the 20 nt sequences such as, but not limited to, any of SEQ ID NO: 5305-125469.

In one example, a guide RNA may comprise a 20 nucleotide (nt) target nucleic acid sequence associated with the PAM type such as, but not limited to, NAAAAC, NNA-GAAW, NNGRRT, NNNNGHTT, NRG, or YTN. As a non-limiting example, the 20 nt target nucleic acid sequence for a specific target gene and a specific PAM type may be, where "T" is "U," the RNA sequence corresponding to any one of the 20 nt nucleic acid sequences in Table 6.

TABLE 6

Nucleic Acid Sequences by PAM Type

| Gene Symbol | PAM: NAAAAC 20 nt Target Nucleic Acid SEQ ID NO | PAM: NNAGAAW 20 nt Target Nucleic Acid SEQ ID NO | PAM: NNGRRT 20 nt Target Nucleic Acid SEQ ID NO | PAM: NNNNGHTT 20 nt Target Nucleic Acid SEQ ID NO | PAM: NRG 20 nt Target Nucleic Acid SEQ ID NO | PAM: YTN 20 nt Target Nucleic Acid SEQ ID NO |
|---|---|---|---|---|---|---|
| SCN9A | 5305-6250 | 6251-8561 | 8562-13614 | 13615-18988 | 18989-56863 | 56864-125469 |

In one example, a guide RNA may comprise a 20 nucleotide (nt) target nucleic acid sequence associated with the YTN PAM type. As a non-limiting example, the 20 nt target nucleic acid sequence for a specific target gene may comprise a 20 nt core sequence where the 20 nt core sequence, where "T" is "U," may be the RNA sequence corresponding to SEQ ID NO: 56864-125469. As another non-limiting example, the 20 nt target nucleic acid sequence for a specific target gene may comprise a core sequence where the core sequence, where "T" is "U," may be a fragment, segment or region of the RNA sequence corresponding to any of SEQ ID NO: 56864-125469.

VI. Other Therapeutic Approaches

Gene editing can be conducted using nucleases engineered to target specific sequences. To date there are four major types of nucleases: meganucleases and their derivatives, zinc finger nucleases (ZFNs), transcription activator like effector nucleases (TALENs), and CRISPR-Cas9 nuclease systems. The nuclease platforms vary in difficulty of design, targeting density and mode of action, particularly as the specificity of ZFNs and TALENs is through protein-DNA interactions, while RNA-DNA interactions primarily guide Cas9.

CRISPR endonucleases, such as Cas9, can be used in the methods of the present disclosure. However, the teachings described herein, such as therapeutic target sites, could be applied to other forms of endonucleases, such as ZFNs, TALENs, HEs, or MegaTALs, or using combinations of nucleases. However, in order to apply the teachings of the present disclosure to such endonucleases, one would need to, among other things, engineer proteins directed to the specific target sites.

Additional binding domains can be fused to the Cas9 protein to increase specificity. The target sites of these constructs would map to the identified gRNA specified site, but would require additional binding motifs, such as for a zinc finger domain. In the case of Mega-TAL, a meganuclease can be fused to a TALE DNA-binding domain. The meganuclease domain can increase specificity and provide the cleavage. Similarly, inactivated or dead Cas9 (dCas9) can be fused to a cleavage domain and require the sgRNA/Cas9 target site and adjacent binding site for the fused DNA-binding domain. This likely would require some protein engineering of the dCas9, in addition to the catalytic inactivation, to decrease binding without the additional binding site.

Zinc Finger Nucleases

Zinc finger nucleases (ZFNs) are modular proteins comprised of an engineered zinc finger DNA binding domain linked to the catalytic domain of the type II endonuclease FokI. Because FokI functions only as a dimer, a pair of ZFNs must be engineered to bind to cognate target "half-site" sequences on opposite DNA strands and with precise spacing between them to enable the catalytically active FokI dimer to form. Upon dimerization of the FokI domain, which itself has no sequence specificity per se, a DNA double-strand break is generated between the ZFN half-sites as the initiating step in genome editing.

The DNA binding domain of each ZFN is typically comprised of 3-6 zinc fingers of the abundant Cys2-His2 architecture, with each finger primarily recognizing a triplet of nucleotides on one strand of the target DNA sequence, although cross-strand interaction with a fourth nucleotide also can be important. Alteration of the amino acids of a finger in positions that make key contacts with the DNA alters the sequence specificity of a given finger. Thus, a four-finger zinc finger protein will selectively recognize a 12 bp target sequence, where the target sequence is a composite of the triplet preferences contributed by each finger, although triplet preference can be influenced to varying degrees by neighboring fingers. An important aspect of ZFNs is that they can be readily re-targeted to almost any genomic address simply by modifying individual fingers, although considerable expertise is required to do this well. In most applications of ZFNs, proteins of 4-6 fingers are used, recognizing 12-18 bp respectively. Hence, a pair of ZFNs will typically recognize a combined target sequence of 24-36 bp, not including the typical 5-7 bp spacer between half-sites. The binding sites can be separated further with larger spacers, including 15-17 bp. A target sequence of this length is likely to be unique in the human genome, assuming repetitive sequences or gene homologs are excluded during the design process. Nevertheless, the ZFN protein-DNA interactions are not absolute in their specificity so off-target binding and cleavage events do occur, either as a heterodimer between the two ZFNs, or as a homodimer of one or the other of the ZFNs. The latter possibility has been effectively eliminated by engineering the dimerization interface of the FokI domain to create "plus" and "minus" variants, also known as obligate heterodimer variants, which can only dimerize with each other, and not with themselves. Forcing the obligate heterodimer prevents formation of the homodimer. This has greatly enhanced specificity of ZFNs, as well as any other nuclease that adopts these FokI variants.

A variety of ZFN-based systems have been described in the art, modifications thereof are regularly reported, and numerous references describe rules and parameters that are used to guide the design of ZFNs; see, e.g., Segal et al., Proc Natl Acad Sci USA 96(6):2758-63 (1999); Dreier B et al., J Mol Biol. 303(4):489-502 (2000); Liu Q et al., J Biol Chem. 277(6):3850-6 (2002); Dreier et al., J Biol Chem 280(42): 35588-97 (2005); and Dreier et al., J Biol Chem. 276(31): 29466-78 (2001).

Transcription Activator-Like Effector Nucleases (TALENs)

TALENs represent another format of modular nucleases whereby, as with ZFNs, an engineered DNA binding domain is linked to the FokI nuclease domain, and a pair of TALENs operate in tandem to achieve targeted DNA cleavage. The major difference from ZFNs is the nature of the DNA binding domain and the associated target DNA sequence recognition properties. The TALEN DNA binding domain derives from TALE proteins, which were originally described in the plant bacterial pathogen *Xanthomonas* sp. TALEs are comprised of tandem arrays of 33-35 amino acid repeats, with each repeat recognizing a single base pair in the target DNA sequence that is typically up to 20 bp in length, giving a total target sequence length of up to 40 bp. Nucleotide specificity of each repeat is determined by the repeat variable diresidue (RVD), which includes just two amino acids at positions 12 and 13. The bases guanine, adenine, cytosine and thymine are predominantly recognized by the four RVDs: Asn-Asn, Asn-Ile, His-Asp and Asn-Gly, respectively. This constitutes a much simpler recognition code than for zinc fingers, and thus represents an advantage over the latter for nuclease design. Nevertheless, as with ZFNs, the protein-DNA interactions of TALENs are not absolute in their specificity, and TALENs have also benefitted from the use of obligate heterodimer variants of the FokI domain to reduce off-target activity.

Additional variants of the FokI domain have been created that are deactivated in their catalytic function. If one half of either a TALEN or a ZFN pair contains an inactive FokI domain, then only single-strand DNA cleavage (nicking) will occur at the target site, rather than a DSB. The outcome is comparable to the use of CRISPR/Cas9 or CRISPR/Cpf1 "nickase" in which one of the Cas9 cleavage domains has been deactivated. DNA nicks can be used to drive genome editing by HDR, but at lower efficiency than with a DSB. The main benefit is that off-target nicks are quickly and accurately repaired, unlike the DSB, which is prone to NHEJ-mediated mis-repair.

A variety of TALEN-based systems have been described in the art, and modifications thereof are regularly reported; see, e.g., Boch, Science 326(5959):1509-12 (2009); Mak et al., Science 335(6069):716-9 (2012); and Moscou et al., Science 326(5959):1501 (2009). The use of TALENs based on the "Golden Gate" platform, or cloning scheme, has been described by multiple groups; see, e.g., Cermak et al., Nucleic Acids Res. 39(12):e82 (2011); Li et al., Nucleic Acids Res. 39(14):6315-25 (2011); Weber et al., PLoS One. 6(2):e16765 (2011); Wang et al., J Genet Genomics 41(6): 339-47, Epub 2014 May 17 (2014); and Cermak T et al., Methods Mol Biol. 1239:133-59 (2015).

Homing Endonucleases

Homing endonucleases (HEs) are sequence-specific endonucleases that have long recognition sequences (14-44 base pairs) and cleave DNA with high specificity—often at sites unique in the genome. There are at least six known families of HEs as classified by their structure, including GIY-YIG, His-Cis box, H—N—H, PD-(D/E)xK, and Vsr-like that are derived from a broad range of hosts, including eukarya, protists, bacteria, archaea, cyanobacteria and phage. As with ZFNs and TALENs, HEs can be used to create a DSB at a target locus as the initial step in genome editing. In addition, some natural and engineered HEs cut only a single strand of DNA, thereby functioning as site-specific nickases. The large target sequence of HEs and the specificity that they offer have made them attractive candidates to create site-specific DSBs.

A variety of HE-based systems have been described in the art, and modifications thereof are regularly reported; see, e.g., the reviews by Steentoft et al., Glycobiology 24(8): 663-80 (2014); Belfort and Bonocora, Methods Mol Biol. 1123:1-26 (2014); Hafez and Hausner, Genome 55(8):553-69 (2012); and references cited therein.

MegaTAL/Tev-mTALEN/MegaTev

As further examples of hybrid nucleases, the MegaTAL platform and Tev-mTALEN platform use a fusion of TALE DNA binding domains and catalytically active HEs, taking advantage of both the tunable DNA binding and specificity of the TALE, as well as the cleavage sequence specificity of the HE; see, e.g., Boissel et al., NAR 42: 2591-2601 (2014); Kleinstiver et al., G3 4:1155-65 (2014); and Boissel and Scharenberg, Methods Mol. Biol. 1239: 171-96 (2015).

In a further variation, the MegaTev architecture is the fusion of a meganuclease (Mega) with the nuclease domain derived from the GIY-YIG homing endonuclease I-TevI (Tev). The two active sites are positioned ~30 bp apart on a DNA substrate and generate two DSBs with non-compatible cohesive ends; see, e.g., Wolfs et al., NAR 42, 8816-29 (2014). It is anticipated that other combinations of existing nuclease-based approaches will evolve and be useful in achieving the targeted genome modifications described herein.

dCas9-FokI or dCpf1-Fok1 and Other Nucleases

Combining the structural and functional properties of the nuclease platforms described above offers a further approach to genome editing that can potentially overcome some of the inherent deficiencies. As an example, the CRISPR genome editing system typically uses a single Cas9 endonuclease to create a DSB. The specificity of targeting is driven by a 20 or 24 nucleotide sequence in the guide RNA that undergoes Watson-Crick base-pairing with the target DNA (plus an additional 2 bases in the adjacent NAG or NGG PAM sequence in the case of Cas9 from *S. pyogenes*). Such a sequence is long enough to be unique in the human genome, however, the specificity of the RNA/DNA interaction is not absolute, with significant promiscuity sometimes tolerated, particularly in the 5' half of the target sequence, effectively reducing the number of bases that drive specificity. One solution to this has been to completely deactivate the Cas9 or Cpf1 catalytic function—retaining only the RNA-guided DNA binding function—and instead fusing a FokI domain to the deactivated Cas9; see, e.g., Tsai et al., Nature Biotech 32: 569-76 (2014); and Guilinger et al., Nature Biotech. 32: 577-82 (2014). Because FokI must dimerize to become catalytically active, two guide RNAs are required to tether two FokI fusions in close proximity to form the dimer and cleave DNA. This essentially doubles the number of bases in the combined target sites, thereby increasing the stringency of targeting by CRISPR-based systems.

As further example, fusion of the TALE DNA binding domain to a catalytically active HE, such as I-TevI, takes advantage of both the tunable DNA binding and specificity of the TALE, as well as the cleavage sequence specificity of I-TevI, with the expectation that off-target cleavage can be further reduced.

VII. Kits

The present disclosure provides kits for carrying out the methods described herein. A kit can include one or more of a genome-targeting nucleic acid, a polynucleotide encoding a genome-targeting nucleic acid, a site-directed polypeptide, a polynucleotide encoding a site-directed polypeptide, and/or any nucleic acid or proteinaceous molecule necessary to carry out the aspects of the methods described herein, or any combination thereof.

A kit can comprise: (1) a vector comprising a nucleotide sequence encoding a genome-targeting nucleic acid, (2) the site-directed polypeptide or a vector comprising a nucleotide sequence encoding the site-directed polypeptide, and (3) a reagent for reconstitution and/or dilution of the vector(s) and or polypeptide.

A kit can comprise: (1) a vector comprising (i) a nucleotide sequence encoding a genome-targeting nucleic acid, and (ii) a nucleotide sequence encoding the site-directed polypeptide; and (2) a reagent for reconstitution and/or dilution of the vector.

In any of the above kits, the kit can comprise a single-molecule guide genome-targeting nucleic acid. In any of the above kits, the kit can comprise a double-molecule genome-targeting nucleic acid. In any of the above kits, the kit can comprise two or more double-molecule guides or single-molecule guides. The kits can comprise a vector that encodes the nucleic acid targeting nucleic acid.

In any of the above kits, the kit can further comprise a polynucleotide to be inserted to effect the desired genetic modification.

Components of a kit can be in separate containers, or combined in a single container.

Any kit described above can further comprise one or more additional reagents, where such additional reagents are selected from a buffer, a buffer for introducing a polypeptide or polynucleotide into a cell, a wash buffer, a control reagent, a control vector, a control RNA polynucleotide, a reagent for in vitro production of the polypeptide from DNA, adaptors for sequencing and the like. A buffer can be a stabilization buffer, a reconstituting buffer, a diluting buffer, or the like. A kit can also comprise one or more components that can be used to facilitate or enhance the on-target binding or the cleavage of DNA by the endonuclease, or improve the specificity of targeting.

In addition to the above-mentioned components, a kit can further comprise instructions for using the components of the kit to practice the methods. The instructions for practicing the methods can be recorded on a suitable recording medium. For example, the instructions can be printed on a substrate, such as paper or plastic, etc. The instructions can be present in the kits as a package insert, in the labeling of the container of the kit or components thereof (i.e., associated with the packaging or subpackaging), etc. The instructions can be present as an electronic storage data file present on a suitable computer readable storage medium, e.g. CD-ROM, diskette, flash drive, etc. In some instances, the actual instructions are not present in the kit, but means for obtaining the instructions from a remote source (e.g. via the Internet), can be provided. An example of this case is a kit that comprises a web address where the instructions can be viewed and/or from which the instructions can be downloaded. As with the instructions, this means for obtaining the instructions can be recorded on a suitable substrate.

VIII. Specific Methods and Compositions of the Invention

Accordingly, the present disclosure relates in particular to the following non-limiting methods according to the present disclosure: In a first method, Method 1, the present disclosure provides a method for editing a Sodium Voltage-Gated Channel Alpha Subunit 9 (SCN9A) gene in a cell by genome editing comprising: introducing into the cell one or more deoxyribonucleic acid (DNA) endonucleases to effect one or more single-strand breaks (SSBs) or double-strand breaks (DSBs) within or near the SCN9A gene or SCN9A regulatory elements that results in one or more permanent insertions, deletions or mutations of at least one nucleotide within or near the SCN9A gene, thereby reducing or eliminating the expression or function of SCN9A gene products.

In another method, Method 2, the present disclosure provides an ex vivo method for treating a patient having an SCN9A related condition or disorder comprising: editing a patient specific induced pluripotent stem cell (iPSC) within or near a Sodium Voltage-Gated Channel Alpha Subunit 9 (SCN9A) gene or other DNA sequences that encode regulatory elements of the SCN9A gene; differentiating the edited iPSC into a neuron of the peripheral nervous system; and administering the neuron of the peripheral nervous system to the patient.

In another method, Method 3, the present disclosure provides an ex vivo method for treating a patient having an SCN9A related condition or disorder comprising: obtaining a patient specific induced pluripotent stem cell (iPSC); editing the iPSC within or near a Sodium Voltage-Gated Channel Alpha Subunit 9 (SCN9A) gene or other DNA sequences that encode regulatory elements of the SCN9A gene; differentiating the edited iPSC into a neuron of the peripheral nervous system; and administering the neuron of the peripheral nervous system to the patient.

In another method, Method 4, the present disclosure provides the method of Methods 2 or 3, wherein the editing step comprises: introducing into the iPSC one or more deoxyribonucleic acid (DNA) endonucleases to effect one or more single-strand breaks (SSBs) or double-strand breaks (DSBs) within or near the SCN9A gene or SCN9A regulatory elements that results in one or more permanent insertions, deletions or mutations of at least one nucleotide within or near the SCN9A gene, thereby reducing or eliminating the expression or function of SCN9A gene products.

In another method, Method 5, the present disclosure provides an ex vivo method for treating a patient having an SCN9A related condition or disorder comprising: editing a mesenchymal stem cell within or near a Sodium Voltage-Gated Channel Alpha Subunit 9 (SCN9A) gene or other DNA sequences that encode regulatory elements of the SCN9A gene; differentiating the edited mesenchymal stem cell into a neuron of the peripheral nervous system; and administering the neuron of the peripheral nervous system to the patient.

In another method, Method 6, the present disclosure provides an ex vivo method for treating a patient having an SCN9A related condition or disorder comprising: obtaining a mesenchymal stem cell from the patient; editing a mesenchymal stem cell within or near a Sodium Voltage-Gated Channel Alpha Subunit 9 (SCN9A) gene or other DNA sequences that encode regulatory elements of the SCN9A gene; differentiating the edited mesenchymal stem cell into a neuron of the peripheral nervous system; and administering the neuron of the peripheral nervous system to the patient.

In another method, Method 7, the present disclosure provides the method of Methods 5 or 6, wherein the editing step comprises: introducing into the mesenchymal stem cell one or more deoxyribonucleic acid (DNA) endonucleases to effect one or more single-strand breaks (SSBs) or double-strand breaks (DSBs) within or near the SCN9A gene or SCN9A regulatory elements that results in one or more permanent insertions, deletions or mutations of at least one nucleotide within or near the SCN9A gene, thereby reducing or eliminating the expression or function of SCN9A gene products.

In another method, Method 8, the present disclosure provides an in vivo method for treating a patient with an SCN9A related disorder comprising: editing the Sodium Voltage-Gated Channel Alpha Subunit 9 (SCN9A) gene in a cell of the patient.

In another method, Method 9, the present disclosure provides the method of Method 8, wherein the editing step comprises: introducing into the cell one or more deoxyribonucleic acid (DNA) endonucleases to effect one or more single-strand breaks (SSBs) or double-strand breaks (DSBs) within or near the SCN9A gene or SCN9A regulatory elements that results in one or more permanent insertions, deletions or mutations of at least one nucleotide within or near the SCN9A gene, thereby reducing or eliminating the expression or function of SCN9A gene products.

In another method, Method 10, the present disclosure provides the method of any one of Methods 8-9, wherein the cell is a neuron of the peripheral nervous system.

In another method, Method 11, the present disclosure provides the method of Method 10, wherein the one or more deoxyribonucleic acid (DNA) endonuclease is delivered to the neuron of the peripheral nervous system via direct intraganglionic or intraspinal injection, or intrathecal delivery.

In another method, Method 12, the present disclosure provides a method of altering the contiguous genomic sequence of an SCN9A gene in a cell comprising: contacting the cell with one or more deoxyribonucleic acid (DNA)

endonuclease to effect one or more single-strand breaks (SSBs) or double-strand breaks (DSBs).

In another method, Method 13, the present disclosure provides the method of Method 12, wherein the alteration of the contiguous genomic sequence occurs in one or more exons of the SCN9A gene.

In another method, Method 14, the present disclosure provides the method of any one of Methods 1-13, wherein the one or more deoxyribonucleic acid (DNA) endonuclease is selected from any of those in SEQ ID NOs: 1-620, and variants having at least 90% homology to any of those listed in SEQ ID NOs: 1-620.

In another method, Method 15, the present disclosure provides the method of Method 14, wherein the one or more deoxyribonucleic acid (DNA) endonuclease is one or more protein or polypeptide.

In another method, Method 16, the present disclosure provides the method of Method 14, wherein the one or more deoxyribonucleic acid (DNA) endonuclease is one or more polynucleotide encoding the one or more DNA endonuclease.

In another method, Method 17, the present disclosure provides the method of Method 16, wherein the one or more deoxyribonucleic acid (DNA) endonuclease is one or more ribonucleic acid (RNA) encoding the one or more DNA endonuclease.

In another method, Method 18, the present disclosure provides the method of Method 17, wherein the one or more ribonucleic acid (RNA) is one or more chemically modified RNA.

In another method, Method 19, the present disclosure provides the method of Method 18, wherein the one or more ribonucleic acid (RNA) is chemically modified in the coding region.

In another method, Method 20, the present disclosure provides the method of any one of Methods 16-19, wherein the one or more polynucleotide or one or more ribonucleic acid (RNA) is codon optimized.

In another method, Method 21, the present disclosure provides the method of any one of Methods 1-20, wherein the method further comprises: introducing into the cell one or more gRNA or one or more sgRNA.

In another method, Method 22, the present disclosure provides the method of Method 21, wherein the one or more gRNA or one or more sgRNA comprises a spacer sequence that is complementary to a DNA sequence within or near the SCN9A gene.

In another method, Method 23, the present disclosure provides the method of any one of Methods 21-22, wherein the one or more gRNA or one or more sgRNA is chemically modified.

In another method, Method 24, the present disclosure provides the method of any one of Methods 21-23, wherein the one or more gRNA or one or more sgRNA is pre-complexed with the one or more deoxyribonucleic acid (DNA) endonuclease.

In another method, Method 25, the present disclosure provides the method of Method 24, wherein the pre-complexing involves a covalent attachment of the one or more gRNA or one or more sgRNA to the one or more deoxyribonucleic acid (DNA) endonuclease.

In another method, Method 26, the present disclosure provides the method of any one of Methods 14-25, wherein the one or more deoxyribonucleic acid (DNA) endonuclease is formulated in a liposome or lipid nanoparticle.

In another method, Method 27, the present disclosure provides the method of any one of Methods 21-25, wherein the one or more deoxyribonucleic acid (DNA) endonuclease is formulated in a liposome or lipid nanoparticle which also comprises the one or more gRNA or one or more sgRNA.

In another method, Method 28, the present disclosure provides the method of any one of Methods 12, or 21-22, wherein the one or more deoxyribonucleic acid (DNA) endonuclease is encoded in an AAV vector particle.

In another method, Method 29, the present disclosure provides the method of any one of Methods 21-22, wherein the one or more gRNA or one or more sgRNA is encoded in an AAV vector particle.

In another method, Method 30, the present disclosure provides the method of any one of Methods 21-22, wherein the one or more deoxyribonucleic acid (DNA) endonuclease is encoded in an AAV vector particle which also encodes the one or more gRNA or one or more sgRNA.

In another method, Method 31, the present disclosure provides the method of any of the Methods 28-30, where the AAV vector particle is selected from the group consisting of any of those disclosed in SEQ ID NOs: 4734-5302 and Table 2.

The present disclosure also provides a composition, Composition 1, comprising a single-molecule guide RNA comprising: at least a spacer sequence that is an RNA sequence corresponding to any of SEQ ID NOs: 5305-125469.

In another composition, Composition 2, the present disclosure provides the single-molecule guide RNA of Composition 1, wherein the single-molecule guide RNA further comprises a spacer extension region.

In another composition, Composition 3, the present disclosure provides the single-molecule guide RNA of Composition 1, wherein the single-molecule guide RNA further comprises a tracrRNA extension region.

In another composition, Composition 4, the present disclosure provides the single-molecule guide RNA of Compositions 1-3, wherein the single-molecule guide RNA is chemically modified.

In another composition, Composition 5, the present disclosure provides a single-molecule guide RNA of Compositions 1-4 pre-complexed with a site-directed polypeptide.

In another composition, Composition 6, the present disclosure provides a single-molecule guide RNA of Compositions 1-5 pre-complexed with a DNA endonuclease.

In another composition, Composition 7, the present disclosure provides the composition of Composition 6, wherein the DNA endonuclease is a Cas9 or Cpf1 endonuclease.

In another composition, Composition 8, the present disclosure provides the composition of Composition 7, wherein the Cas9 or Cpf1 endonuclease is selected from the group consisting of: *S. pyogenes* Cas9, *S. aureus* Cas9, *N. meningitides* Cas9, *S. thermophilus* CRISPR1 Cas9, *S. thermophilus* CRISPR 3 Cas9, *T. denticola* Cas9, *L. bacterium* ND2006 Cpf1 and *Acidaminococcus* sp. BV3L6 Cpf1, and variants having at least 90% homology to the endonucleases.

In another composition, Composition 9, the present disclosure provides the composition of Composition 8, wherein the Cas9 or Cpf1 endonuclease comprises one or more nuclear localization signals (NLSs).

In another composition, Composition 10, the present disclosure provides the composition of Composition 9, wherein at least one NLS is at or within 50 amino acids of the amino-terminus of the Cas9 or Cpf1 endonuclease and/or at least one NLS is at or within 50 amino acids of the carboxy-terminus of the Cas9 or Cpf1 endonuclease.

In another composition, Composition 11, the present disclosure provides a DNA encoding the single-molecule guide RNA of any of Compositions 1-4.

In another composition, Composition 12, the present disclosure provides a non-naturally occurring CRISPR/Cas system comprising a polynucleotide encoding a Cas9 or Cpf1 endonuclease and at least one single-molecule guide RNA of Compositions 1-4.

In another composition, Composition 13, the present disclosure provides the CRISPR/Cas system of Composition 11, wherein the polynucleotide encoding a Cas9 or Cpf1 endonuclease is selected from the group consisting of: *S. pyogenes* Cas9, *S. aureus* Cas9, *N. meningitides* Cas9, *S. thermophilus* CRISPR1 Cas9, *S. thermophilus* CRISPR 3 Cas9, *T. denticola* Cas9, *L. bacterium* ND2006 Cpf1 and *Acidaminococcus* sp. BV3L6 Cpf1, and variants having at least 90% homology to the endonucleases.

In another composition, Composition 14, the present disclosure provides the CRISPR/Cas system of Composition 13, wherein the polynucleotide encoding a Cas9 or Cpf1 endonuclease comprises one or more nuclear localization signals (NLSs).

In another composition, Composition 15, the present disclosure provides the CRISPR/Cas system of Composition 14, wherein at least one NLS is at or within 50 amino acids of the amino-terminus of the polynucleotide encoding a Cas9 or Cpf1 endonuclease and/or at least one NLS is at or within 50 amino acids of the carboxy-terminus of the polynucleotide encoding a Cas9 or Cpf1 endonuclease.

In another composition, Composition 16, the present disclosure provides the CRISPR/Cas system of Composition 15, wherein the polynucleotide encoding a Cas9 or Cpf1 endonuclease is codon optimized for expression in a eukaryotic cell.

In another composition, Composition 17, the present disclosure provides a DNA encoding the CRISPR/Cas system of any one of Compositions 12-16.

In another composition, Composition 18, the present disclosure provides a vector comprising the DNA of any one of Compositions 12-17.

In another composition, Composition 19, the present disclosure provides the vector of Composition 18, wherein the vector is a plasmid.

In another composition, Composition 20, the present disclosure provides the vector of Composition 18, wherein the vector is an AAV vector particle, and the AAV vector serotype is selected from the group consisting of those disclosed in SEQ ID NOs: 4734-5302 and Table 2.

IX. Definitions

The term "comprising" or "comprises" is used in reference to compositions, methods, and respective component(s) thereof, that are essential to the present disclosure, yet open to the inclusion of unspecified elements, whether essential or not.

The term "consisting essentially of" refers to those elements required for a given aspect. The term permits the presence of additional elements that do not materially affect the basic and novel or functional characteristic(s) of that aspect of the present disclosure.

The term "consisting of" refers to compositions, methods, and respective components thereof as described herein, which are exclusive of any element not recited in that description of the aspect.

The singular forms "a," "an," and "the" include plural references, unless the context clearly dictates otherwise.

Any numerical range recited in this specification describes all sub-ranges of the same numerical precision (i.e., having the same number of specified digits) subsumed within the recited range. For example, a recited range of "1.0 to 10.0" describes all sub-ranges between (and including) the recited minimum value of 1.0 and the recited maximum value of 10.0, such as, for example, "2.4 to 7.6," even if the range of "2.4 to 7.6" is not expressly recited in the text of the specification. Accordingly, the Applicant reserves the right to amend this specification, including the claims, to expressly recite any sub-range of the same numerical precision subsumed within the ranges expressly recited in this specification. All such ranges are inherently described in this specification such that amending to expressly recite any such sub-ranges will comply with written description, sufficiency of description, and added matter requirements, including the requirements under 35 U.S.C. § 112(a) and Article 123(2) EPC. Also, unless expressly specified or otherwise required by context, all numerical parameters described in this specification (such as those expressing values, ranges, amounts, percentages, and the like) may be read as if prefaced by the word "about," even if the word "about" does not expressly appear before a number. Additionally, numerical parameters described in this specification should be construed in light of the number of reported significant digits, numerical precision, and by applying ordinary rounding techniques. It is also understood that numerical parameters described in this specification will necessarily possess the inherent variability characteristic of the underlying measurement techniques used to determine the numerical value of the parameter.

The details of one or more examples of the present disclosure are set forth in the accompanying description below. Although any materials and methods similar or equivalent to those described herein can be used in the practice or testing of the present disclosure, the preferred materials and methods are now described. Other features, objects and advantages of the present disclosure will be apparent from the description. In the description, the singular forms also include the plural unless the context clearly dictates otherwise. Unless defined otherwise, all technical and scientific terms used herein have the same meaning as commonly understood by one of ordinary skill in the art to which this present disclosure belongs. In the case of conflict, the present description will control.

The present disclosure is further illustrated by the following non-limiting examples.

X. Examples

The present disclosure will be more fully understood by reference to the following examples, which provide illustrative non-limiting aspects of the invention.

The examples describe the use of the CRISPR system as an illustrative genome editing technique to create defined therapeutic genomic deletions, insertions, or replacements, termed "genomic modifications" herein, in the SCN9A gene that lead to permanent deletion or mutation of the SCN9A gene, that reduce or eliminate the SCN9A protein activity. Introduction of the defined therapeutic modifications represents a novel therapeutic strategy for the potential amelioration of Pain, as described and illustrated herein.

Various Cas orthologs are evaluated for cutting. gRNAs are delivered as RNA and expressed from the U6 promoter in plasmids. The corresponding Cas protein is either knocked into the cell line of interest and constitutively expressed, delivered as mRNA, or delivered as protein. The gRNA activity in all formats is evaluated using TIDE analysis in HEK293T cells.

Introduction of the defined therapeutic modifications described above represents a novel therapeutic strategy for the potential amelioration of Pain and related disorders, as described and illustrated herein.

Example 1

CRISPR/SpCas9 Target Sites for the SCN9A Gene

Regions of the SCN9A gene were scanned for target sites. Each area was scanned for a protospacer adjacent motif (PAM) having the sequence NRG. gRNA 20 bp spacer sequences corresponding to the PAM were then identified, as shown in SEQ ID NOs: 18989-56863 of the Sequence Listing.

Example 2

CRISPR/SaCas9 Target Sites for the SCN9A Gene

Regions of the SCN9A gene were scanned for target sites. Each area was scanned for a protospacer adjacent motif (PAM) having the sequence NNGRRT. gRNA 20 bp spacer sequences corresponding to the PAM were then identified, as shown in SEQ ID NOs: 8562-13614 of the Sequence Listing.

Example 3

CRISPR/StCas9 Target Sites for the SCN9A Gene

Regions of the SCN9A gene were scanned for target sites. Each area was scanned for a protospacer adjacent motif (PAM) having the sequence NNAGAAW. gRNA 20 bp spacer sequences corresponding to the PAM were then identified, as shown in SEQ ID NOs: 6251-8561 of the Sequence Listing.

Example 4

CRISPR/TdCas9 Target Sites for the SCN9A Gene

Regions of the SCN9A gene were scanned for target sites. Each area was scanned for a protospacer adjacent motif (PAM) having the sequence NAAAAC. gRNA 20 bp spacer sequences corresponding to the PAM were then identified, as shown in SEQ ID NOs: 5305-6250 of the Sequence Listing.

Example 5

CRISPR/NmCas9 Target Sites for the SCN9A Gene

Regions of the SCN9A gene were scanned for target sites. Each area was scanned for a protospacer adjacent motif (PAM) having the sequence NNNNGHTT. gRNA 20 bp spacer sequences corresponding to the PAM were then identified, as shown in SEQ ID NOs: 13615-18988 of the Sequence Listing.

Example 6

CRISPR/Cpf1 Target Sites for the SCN9A Gene

Regions of the SCN9A gene were scanned for target sites. Each area was scanned for a protospacer adjacent motif (PAM) having the sequence YTN. gRNA 20 bp spacer sequences corresponding to the PAM were then identified, as shown in SEQ ID NOs: 56864-125469 of the Sequence Listing.

Example 7

Bioinformatics Analysis of the Guide Strands

Candidate guides will then screened and selected in a single process or multi-step process that involves both theoretical binding and experimentally assessed activity at both on-target and off-target sites. By way of illustration, candidate guides having sequences that match a particular on-target site, such as a site within the SCN9A gene, with adjacent PAM can be assessed for their potential to cleave at off-target sites having similar sequences, using one or more of a variety of bioinformatics tools available for assessing off-target binding, as described and illustrated in more detail below, in order to assess the likelihood of effects at chromosomal positions other than those intended.

Candidates predicted to have relatively lower potential for off-target activity can then be assessed experimentally to measure their on-target activity, and then off-target activities at various sites. Preferred guides have sufficiently high on-target activity to achieve desired levels of gene editing at the selected locus, and relatively lower off-target activity to reduce the likelihood of alterations at other chromosomal loci. The ratio of on-target to off-target activity is often referred to as the "specificity" of a guide.

For initial screening of predicted off-target activities, there are a number of bioinformatics tools known and publicly available that can be used to predict the most likely off-target sites; and since binding to target sites in the CRISPR/Cas9 or CRISPR/Cpf1 nuclease system is driven by Watson-Crick base pairing between complementary sequences, the degree of dissimilarity (and therefore reduced potential for off-target binding) is essentially related to primary sequence differences: mismatches and bulges, i.e. bases that are changed to a non-complementary base, and insertions or deletions of bases in the potential off-target site relative to the target site. An exemplary bioinformatics tool called COSMID (CRISPR Off-target Sites with Mismatches, Insertions and Deletions) (available on the web at crispr.b-me.gatech.edu) compiles such similarities. Other bioinformatics tools include, but are not limited to, autoCOSMID and CCTop.

Bioinformatics were used to minimize off-target cleavage in order to reduce the detrimental effects of mutations and chromosomal rearrangements. Studies on CRISPR/Cas9 systems suggested the possibility of off-target activity due to non-specific hybridization of the guide strand to DNA sequences with base pair mismatches and/or bulges, particularly at positions distal from the PAM region. Therefore, it is important to have a bioinformatics tool that can identify potential off-target sites that have insertions and/or deletions between the RNA guide strand and genomic sequences, in addition to base-pair mismatches. Bioinformatics tools based upon the off-target algorithm CCTop were used to search genomes for potential CRISPR off-target sites (CCTop is available on the web at crispr.cos.uni-heidelberg.de/). The output ranked lists of the potential off-target sites based on the number and location of mismatches, allowing more informed choice of target sites, and avoiding the use of sites with more likely off-target cleavage.

Additional bioinformatics pipelines are employed that weigh the estimated on- and/or off-target activity of gRNA targeting sites in a region. Other features that may be used to predict activity include information about the cell type in question, DNA accessibility, chromatin state, transcription factor binding sites, transcription factor binding data, and other CHIP-seq data. Additional factors are weighed that predict editing efficiency, such as relative positions and directions of pairs of gRNAs, local sequence features and micro-homologies.

Initial evaluation and screening of CRISPR/Cas9 target sites focused on Exons 2-17 of the SCN9A gene and 100-300 bp of sequences from Introns 2-16 that flank these exons. These gRNAs can also be used to edit one or more nucleotides, exonic sequences and/or intronic sequences.

Initial bioinformatics analysis identified, 602 gRNAs targeting Exons 2-17, Introns 2-16, and 100-300 bp sequences flanking the intronic sequences. Further analysis of predicted off-target sites and evaluation of the gRNA target site within the SCN9A gene resulted in 192 gRNAs selected for screening. The prioritized list of 192 single gRNAs targeting the SCN9A gene was tested for cutting efficiencies using spCas9 (Table 7).

TABLE 7

| SEQ ID NO. | Name | Sequence |
| --- | --- | --- |
| 46832 | SCN9A_Int13_Int14_T4 | TGTGCAAATCTGTACCACCA |
| 49122 | SCN9A_Int5_Int6_T10 | CAAATAGTTGGAGTTATGAG |
| 49431 | SCN9A_Int2_Int5_T31 | CAGCAGTTTACCTTTCTACA |
| 47474 | SCN9A_Int10_Int11_T22 | CACCTATTAGCATAACAACA |
| 47446 | SCN9A_Int10_Int11_T6 | TATGCCCTTCGACACCAAGG |
| 28779 | SCN9A_Int8_Int9_T21 | GAGCTTTGACACTTTCAGCT |
| 29821 | SCN9A_Int6_Int7_T3 | CAGGCCTGAAGACAATTGTA |
| 28146 | SCN9A_Int10_Int11_T17 | GTGAAAGATGTCCTGTCCTA |
| 49436 | SCN9A_Int2_Int5_T35 | GCCATCAGACTCCAGCAATG |
| 47224 | SCN9A_Int11_Int12_T26 | CTGGCAGAAGCTGTCCATTG |
| 47462 | SCN9A_Int10_Int11_T12 | CCGCTGCCGCTGCAATTGCC |
| 47240 | SCN9A_Int11_Int12_T3 | CGTTCACCGGCAGCATTGGT |
| 27323 | SCN9A_Int14_Int15_T1 | AGTTCTGCGATCATTCAGAC |
| 27522 | SCN9A_Int13_Int14_T2 | GGAACACCACCCAATGACTG |
| 27893 | SCN9A_Int11_Int12_T20 | TAGGTCCCCACCAATGCTGC |
| 47261 | SCN9A_Int11_Int12_T28 | AAGGAGCCACGAATGCTGAG |
| 28137 | SCN9A_Int10_Int11_T21 | GCCCAACCAGGCAATTGCAG |
| 49367 | SCN9A_Int2_Int5_T8 | CCAGTCCGGTGGGTTATTCA |
| 47232 | SCN9A_Int11_Int12_T8 | GGCTGAGCGTCCATCAACCA |
| 47445 | SCN9A_Int10_Int11_T7 | GCCTATGCCCTTCGACACCA |
| 49313 | SCN9A_Int2_Int5_T38 | TATATTGGAGGATGGCTGTT |
| 47267 | SCN9A_Int11_Int12_T24 | ATAAATACCACTGAACCCAC |
| 30622 | SCN9A_Int1_Int2_T9 | CCATCCAGGCCTCTTATGTG |
| 47231 | SCN9A_Int11_Int12_T5 | GGGCTGAGCGTCCATCAACC |
| 26766 | SCN9A_Int16_Int17_T10 | TGACAGTGCCAATTGCACCT |
| 28139 | SCN9A_Int10_Int11_T4 | GTTAACGTCTTGGCCCAACC |
| 46079 | SCN9A_Int16_Int17_T9 | TAGGTTTAGGACCTATATCA |
| 48091 | SCN9A_Int8_Int9_T18 | CTCAAGGTTTCTTCTATAGG |

TABLE 7-continued

| SEQ ID NO. | Name | Sequence |
| --- | --- | --- |
| 46833 | SCN9A_Int13_Int14_T1 | GCAAATCTGTACCACCAAGG |
| 26765 | SCN9A_Int16_Int17_T16 | GACAGTGCCAATTGCACCTG |
| 27876 | SCN9A_Int11_Int12_T27 | GCCAGAGGTGATAATAGATA |
| 47241 | SCN9A_Int11_Int12_T18 | GTTCACCGGCAGCATTGGTG |
| 47248 | SCN9A_Int11_Int12_T22 | GCGTCGCTCCTGGGGTCTGT |
| 30051 | SCN9A_Int2_Int5_T34 | CCCAATGGAATCTTGTGTTT |
| 30111 | SCN9A_Int2_Int5_T18 | TATGACCATGAATAACCCAC |
| 28760 | SCN9A_Int8_Int9_T16 | TGTTAAGAGCCTGTATTAGG |
| 28085 | SCN9A_Int10_Int11_T23 | ATAGGCGAGCACATGAAAAG |
| 27254 | SCN9A_Int15_Int16_T19 | AAGATCATTGGTAACTCAGT |
| 30163 | SCN9A_Int2_Int5_T9 | GATAGATGCGTTGATGACAT |
| 49303 | SCN9A_Int2_Int5_T44 | CCTAAACACAAGATTCCATT |
| 28083 | SCN9A_Int10_Int11_T2 | GAGGTTGTCTACCCCCAATC |
| 49344 | SCN9A_Int2_Int5_T30 | GCAGGTTAATATCATAGAGG |
| 47245 | SCN9A_Int11_Int12_T2 | GTTACTGCTGCGTCGCTCCT |
| 48090 | SCN9A_Int8_Int9_T22 | ACTCAAGGTTTCTTCTATAG |
| 28132 | SCN9A_Int10_Int11_T16 | CGGCTGAATATACAAGTATT |
| 27328 | SCN9A_Int14_Int15_T2 | GGAGCTCTTTCTAGCAGATG |
| 46078 | SCN9A_Int16_Int17_T8 | ATAGGTTTAGGACCTATATC |
| 28773 | SCN9A_Int8_Int9_T7 | GCTAATGACCCAAGATTACT |
| 46496 | SCN9A_Int15_Int16_T12 | ACATCTGGTTACATACCACC |
| 27885 | SCN9A_Int11_Int12_T23 | GGTGTGGTCTCCCTGGTTGA |
| 29928 | SCN9A_Int5_Int6_T2 | AATACCTTGACTAAAGGCTC |
| 27933 | SCN9A_Int11_Int12_T7 | CAGTCACCACTCAGCATTCG |
| 46039 | SCN9A_Int16_Int17_T2 | TTTTCCAAATCGGATTCCCC |
| 47439 | SCN9A_Int10_Int11_T10 | CAATTTGGGTGGTACCTGAT |
| 28774 | SCN9A_Int8_Int9_T1 | GGCTAATGACCCAAGATTAC |
| 47455 | SCN9A_Int10_Int11_T24 | AGCACTTTTAGAGCTCAGTT |
| 30020 | SCN9A_Int2_Int5_T24 | TATGAAAGCTAGTCATTGAT |
| 47236 | SCN9A_Int11_Int12_T15 | CTGTGCATTTTCCCGTTCAC |
| 28089 | SCN9A_Int10_Int11_T3 | ACCTTGGTGTCGAAGGGCAT |
| 26813 | SCN9A_Int16_Int17_T14 | ATAGGTCCTAAACCTATTTC |
| 47464 | SCN9A_Int10_Int11_T9 | GCCGCTGCAATTGCCTGGTT |
| 28091 | SCN9A_Int10_Int11_T8 | GTTTCCACCTTGGTGTCGAA |
| 29908 | SCN9A_Int5_Int6_T11 | AGTAATTGGTGTGAAGCATT |
| 27892 | SCN9A_Int11_Int12_T12 | CCACCAATGCTGCCGGTGAA |
| 28776 | SCN9A_Int8_Int9_T15 | GGGCCTTCTTAGCCTTGTTT |
| 28783 | SCN9A_Int8_Int9_T17 | ATTGGCAGAAACCCTGATTA |
| 27252 | SCN9A_Int15_Int16_T13 | GATCATTGGTAACTCAGTAG |

TABLE 7-continued

| SEQ ID NO. | Name | Sequence |
|---|---|---|
| 29930 | SCN9A_Int5_Int6_T12 | GTAGAAAATACCTTGACTAA |
| 47625 | SCN9A_Int9_Int10_T1 | CCAGCAGCACGCAGCGTCTA |
| 49945 | SCN9A_Int1_Int2_T16 | AGCAATGCGTTGTTCAATGA |
| 30106 | SCN9A_Int2_Int5_T10 | ACCAAAAATGTCGAGTAAGT |
| 48060 | SCN9A_Int8_Int9_T12 | TTGGGTCATTAGCCTAAACA |
| 29831 | SCN9A_Int6_Int7_T8 | GATATAATGCATGACTTTCT |
| 47239 | SCN9A_Int11_Int12_T10 | CCGTTCACCGGCAGCATTGG |
| 49355 | SCN9A_Int2_Int5_T41 | TCATAAATGCAGTAACTTCC |
| 26774 | SCN9A_Int16_Int17_T7 | CAGCGTGGACAAACACTTGA |
| 30050 | SCN9A_Int2_Int5_T15 | GTGTTTAGGTACACTTTTAC |
| 47246 | SCN9A_Int11_Int12_T9 | TTACTGCTGCGTCGCTCCTG |
| 27250 | SCN9A_Int15_Int16_T16 | GGTAACTCAGTAGGGGCTCT |
| 49124 | SCN9A_Int5_Int6_T9 | ACACCAATTACTTCTTACCT |
| 30053 | SCN9A_Int2_Int5_T22 | TTTCACATCTAGTATCCCAA |
| 49362 | SCN9A_Int2_Int5_T11 | ACCCACTTACTCGACATTTT |
| 47238 | SCN9A_Int11_Int12_T11 | TTCCCGTTCACCGGCAGCAT |
| 49418 | SCN9A_Int2_Int5_T45 | AAGCAGGTGTGGCATTGAAA |
| 27544 | SCN9A_Int13_Int14_T3 | ATGCCTGACTGATTTGTATC |
| 46080 | SCN9A_Int16_Int17_T5 | GTTTAGGACCTATATCAGGG |
| 26775 | SCN9A_Int16_Int17_T15 | CAGTGGTTTTGGAAGCAGCG |
| 30079 | SCN9A_Int2_Int5_T4 | ATTTTTGATAGAAGCAATGT |
| 48052 | SCN9A_Int8_Int9_T8 | TTCTCTTGGTACTCACCTGT |
| 46081 | SCN9A_Int16_Int17_T6 | TTTAGGACCTATATCAGGGT |
| 49424 | SCN9A_Int2_Int5_T40 | ATACTATGAAAGTCTGCAGG |
| 47440 | SCN9A_Int10_Int11_T14 | AATTTGGGTGGTACCTGATT |
| 49331 | SCN9A_Int2_Int5_T36 | TGTGTAACATGTCTAAGAAC |
| 30612 | SCN9A_Int1_Int2_T5 | ATGGCAATGTTGCCTCCCCC |
| 47441 | SCN9A_Int10_Int11_T18 | ATTTGGGTGGTACCTGATTG |
| 47626 | SCN9A_Int9_Int10_T7 | ACGCAGCGTCTAGGGAAAAA |
| 49314 | SCN9A_Int2_Int5_T23 | GGAGGATGGCTGTTGGGTTA |
| 27530 | SCN9A_Int13_Int14_T5 | TCTGGAATTGCTCTCCATAT |
| 48081 | SCN9A_Int8_Int9_T14 | TTATAGGTGAGAGTGTCTTC |
| 30065 | SCN9A_Int2_Int5_T42 | TAGACCTATTGTAGTTTAAT |
| 46040 | SCN9A_Int16_Int17_T4 | TCGGATTCCCCAGGTGCAAT |
| 49962 | SCN9A_Int1_Int2_T24 | AGCTCCTCACATAAGAGGCC |
| 49976 | SCN9A_Int1_Int2_T14 | CTAGAATTATCAGCTTGTTA |
| 27248 | SCN9A_Int_15_Int16_T15 | AGGTAACCTCACCTTAGTGT |
| 29814 | SCN9A_Int6_Int7_T2 | CTGAGTGTGTTTGCACTAAT |
| 30162 | SCN9A_Int2_Int5_T25 | TGACATTGGAACCACATTGC |
| 49302 | SCN9A_Int2_Int5_T33 | ACCTAAACACAAGATTCCAT |
| 49366 | SCN9A_Int2_Int5_T1 | CATTTTTGGTCCAGTCCGGT |
| 26764 | SCN9A_Int16_Int17_T1 | TGCACCTGGGGAATCCGATT |
| 46082 | SCN9A_Int16_Int17_T11 | TTAGGACCTATATCAGGGTG |
| 49048 | SCN9A_Int6_Int7_T1 | AAGCCCCTACAATTGTCTTC |
| 28788 | SCN9A_Int8_Int9_T11 | CGTGTGTAGTCAGTGTCCAG |
| 47633 | SCN9A_Int9_Int10_T10 | CATGAGCAAATCTGACAGTT |
| 49290 | SCN9A_Int2_Int5_T28 | CAAAATCCAGCCAGTTCCAC |
| 27222 | SCN9A_Int15_Int16_T17 | TACATGATGGTCATGGTCAT |
| 30107 | SCN9A_Int2_Int5_T14 | GACCAAAAATGTCGAGTAAG |
| 27336 | SCN9A_Int14_Int15_T3 | ATGAGTATTTCCAAGTAGGC |
| 49142 | SCN9A_Int5_Int6_T3 | CTTACCTGAGCCTTTAGTCA |
| 48073 | SCN9A_Int8_Int9_T4 | TTCACACAGGTGTACCCCTC |
| 28305 | SCN9A_Int9_Int10_T9 | CTTTGTCGTAGTGATTTTCC |
| 49145 | SCN9A_Int5_Int6_T4 | CAAGGTATTTTCTACGTTTG |
| 30061 | SCN9A_Int2_Int5_T32 | CTCCAATATATGTCTTCCAG |
| 47463 | SCN9A_Int10_Int11_T11 | TGCCGCTGCAATTGCCTGGT |
| 48054 | SCN9A_Int8_Int9_T5 | TGGTACTCACCTGTTGGTAA |
| 49365 | SCN9A_Int2_Int5_T6 | ACATTTTTGGTCCAGTCCGG |
| 27253 | SCN9A_Int15_Int16_T18 | AGATCATTGGTAACTCAGTA |
| 49352 | SCN9A_Int2_Int5_T37 | AGCAAGCATATAACATGGGA |
| 30110 | SCN9A_Int2_Int5_T2 | CCATGAATAACCCACCGGAC |
| 27887 | SCN9A_Int11_Int12_T14 | TGCTGTGGACTGCAACGGTG |
| 47243 | SCN9A_Int11_Int12_T17 | TTGGTGGGACCTACTGGCT |
| 27868 | SCN9A_Int11_Int12_125 | TTACATAGCTCAGGCATGGC |
| 27891 | SCN9A_Int11_Int12_T6 | CACCAATGCTGCCGGTGAAC |
| 46834 | SCN9A_Int13_Int14_T7 | CCAAGGTGGACATTTTTGTC |
| 30043 | SCN9A_Int2_Int5_T5 | TCACTTTTCTTCGTGACCCG |
| 49944 | SCN9A_Int1_Int2_T2 | CAGCAATGCGTTGTTCAATG |
| 49316 | SCN9A_Int2_Int5_T29 | ACACCCTATTAAACTACAAT |
| 26767 | SCN9A_Int16_Int17_T3 | GTGACAGTGCCAATTGCACC |
| 28273 | SCN9A_Int9_Int10_T3 | GAGGCTCTGCGGTATATGCT |
| 47242 | SCN9A_Int11_Int12_T13 | CAGCATTGGTGGGACCTAC |
| 47624 | SCN9A_Int9_Int10_T2 | GCCAGCAGCACGCAGCGTCT |
| 29811 | SCN9A_Int6_Int7_T6 | ATTGGACTACAGCTGTTCAT |
| 49422 | SCN9A_Int2_Int5_T27 | TCAATACTATGAAAGTCTGC |
| 28081 | SCN9A_Int10_Int11_T1 | TGCTAAATGTGTATCACCCG |
| 46050 | SCN9A_Int16_Int17_T17 | TGCTCATTTCAGCAAGTGTA |

TABLE 7-continued

| SEQ ID NO. | Name | Sequence |
|---|---|---|
| 27870 | SCN9A_Int11_Int12_T16 | AAGGACGTTTTACATAGCTC |
| 47472 | SCN9A_Int10_Int11_T15 | ATCCTAGGAAACCCTAGGAC |
| 49952 | SCN9A_Int1_Int2_T27 | TGGACAAAGCTCTGAGGTCC |
| 28780 | SCN9A_Int8_Int9_T9 | CGAGCTTTGACACTTTCAGC |
| 46099 | SCN9A_Int16_Int17_T13 | AAGTACACTTTTCCGAATAT |
| 49143 | SCN9A_Int5_Int6_T1 | GTCAAGGTATTTTCTACGTT |
| 28150 | SCN9A_Int10_Int11_T19 | CACCATGTTGTTATGCTAAT |
| 27873 | SCN9A_Int11_Int12_T4 | CAACTTCTGATGACAGCGTA |
| 47244 | SCN9A_Int11_Int12_T1 | TGTTACTGCTGCGTCGCTCC |
| 30041 | SCN9A_Int2_Int5_T7 | TCGTGACCCGTGGAACTGGC |
| 47604 | SCN9A_Int9_Int10_T8 | TAGCTTCTTCAATGTTTGCC |
| 49357 | SCN9A_Int2_Int5_T43 | AAATGCAGTAACTTCCTGGC |
| 28275 | SCN9A_Int9_Int10_T5 | AATGCAAACGGTTACAACAG |
| 28092 | SCN9A_Int10_Int11_T5 | AGTTTCCACCTTGGTGTCGA |
| 49283 | SCN9A_Int2_Int5_T19 | CCCCAGAGGTTTGCTGTTAT |
| 28141 | SCN9A_Int10_Int11_T13 | TCATTTAAGTGTTAACGTCT |
| 30628 | SCN9A_Int1_Int2_T20 | TTTAATGGGCCTTTCTTGGC |
| 46066 | SCN9A_Int16_Int17_T12 | ATCTGGAGGTTGTTTGCATC |
| 49364 | SCN9A_Int2_Int5_T12 | TCGACATTTTTGGTCCAGTC |
| 28307 | SCN9A_Int9_Int10_T4 | CCCTAGACGCTGCGTGCTGC |
| 28143 | SCN9A_Int10_Int11_T20 | TCCTAGGGTTTCCTAGGATT |

Note that the SEQ ID NOs represent the DNA sequence of the genomic target, while the gRNA or sgRNA spacer sequence will be the RNA version of the DNA sequence.

Example 8

Testing of Preferred Guides in In Vitro Transcribed (IVT) gRNA Screen

To identify a large spectrum of pairs of gRNAs able to edit the cognate DNA target region, an in vitro transcribed (IVT) gRNA screen was conducted. The relevant genomic sequence was submitted for analysis using a gRNA design software. The resulting list of gRNAs were narrowed to a select list of gRNAs as described above based on uniqueness of sequence (only gRNAs without a perfect match somewhere else in the genome were screened) and minimal predicted off targets. This set of gRNAs was in vitro transcribed, and transfected using Lipofectamine MessengerMAX into HEK293T cells that constitutively express Cas9. Cells were harvested 48 hours post transfection, the genomic DNA was isolated, and cutting efficiency was evaluated using TIDE analysis. (FIGS. 2A-G; FIGS. 3A-C).

The gRNA or pairs of gRNA with significant activity can then be followed up in cultured cells to measure SCN9A protein expression. Off-target events can be followed again. A variety of cells can be transfected and the level of gene correction and possible off-target events measured. These experiments allow optimization of nuclease and donor design and delivery.

Example 9

Testing of Preferred Guides in Cells for Off-Target Activity

The gRNAs having the best on-target activity from the IVT screen in the above example are tested for off-target activity using Hybrid capture assays, GUIDE Seq. and whole genome sequencing in addition to other methods.

Example 10

In Vivo Testing in Relevant Animal Model

After the CRISPR-Cas9/guide combinations have been re-assessed, the lead formulations will be tested in vivo in an animal model.

Culture in human cells allows direct testing on the human target and the background human genome, as described above.

Preclinical efficacy and safety evaluations can be observed through engraftment of modified mouse or human neurons of the peripheral nervous system in a mouse model. The modified cells can be observed in the months after engraftment.

XI. EQUIVALENTS AND SCOPE

Those skilled in the art will recognize, or be able to ascertain using no more than routine experimentation, many equivalents to the specific examples in accordance with the invention described herein. The scope of the present disclosure is not intended to be limited to the above Description, but rather is as set forth in the appended claims.

Claims or descriptions that include "or" between one or more members of a group are considered satisfied if one, more than one, or all of the group members are present in, employed in, or otherwise relevant to a given product or process unless indicated to the contrary or otherwise evident from the context. The present disclosure includes examples in which exactly one member of the group is present in, employed in, or otherwise relevant to a given product or process. The present disclosure includes examples in which more than one, or the entire group members are present in, employed in, or otherwise relevant to a given product or process.

In addition, it is to be understood that any particular example of the present disclosure that falls within the prior art may be explicitly excluded from any one or more of the claims. Since such examples are deemed to be known to one of ordinary skill in the art, they may be excluded even if the exclusion is not set forth explicitly herein. Any particular example of the compositions of the present disclosure (e.g., any antibiotic, therapeutic or active ingredient; any method of production; any method of use; etc.) can be excluded from any one or more claims, for any reason, whether or not related to the existence of prior art.

It is to be understood that the words which have been used are words of description rather than limitation, and that changes may be made within the purview of the appended claims without departing from the true scope and spirit of the present disclosure in its broader aspects.

While the present invention has been described at some length and with some particularity with respect to the several described examples, it is not intended that it should be limited to any such particulars or examples or any particular example, but it is to be construed with references to the appended claims so as to provide the broadest possible interpretation of such claims in view of the prior art and, therefore, to effectively encompass the intended scope of the invention.

NOTE REGARDING ILLUSTRATIVE EXAMPLES

While the present disclosure provides descriptions of various specific aspects for the purpose of illustrating various aspects of the present disclosure and/or its potential applications, it is understood that variations and modifications will occur to those skilled in the art. Accordingly, the invention or inventions described herein should be understood to be at least as broad as they are claimed, and not as more narrowly defined by particular illustrative aspects provided herein.

Any patent, publication, or other disclosure material identified herein is incorporated by reference into this specification in its entirety unless otherwise indicated, but only to the extent that the incorporated material does not conflict with existing descriptions, definitions, statements, or other disclosure material expressly set forth in this specification. As such, and to the extent necessary, the express disclosure as set forth in this specification supersedes any conflicting material incorporated by reference. Any material, or portion thereof, that is said to be incorporated by reference into this specification, but which conflicts with existing definitions, statements, or other disclosure material set forth herein, is only incorporated to the extent that no conflict arises between that incorporated material and the existing disclosure material. Applicants reserve the right to amend this specification to expressly recite any subject matter, or portion thereof, incorporated by reference herein.

SEQUENCE LISTING (125503 sequences)

SEQ ID NO: 1 - protein, 1368 aa, Streptococcus pyogenes [sequence omitted]

SEQ ID NO: 2 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 3 - DNA, 4107 bp, Streptococcus pyogenes
atggacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggctgctatcgtgccccagtcttttctcaaagatgattctattgataataaagtgttgacaagatccgataaagctagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagactaa

SEQ ID NO: 4 - DNA, 4140 bp, Streptococcus pyogenes
atggacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtga

SEQ ID NO: 5 - DNA, 4200 bp, Streptococcus pyogenes
atggacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacgcggccgcagatccaaaaaagaagagaaaggtagatccaaaaaagaagagaaaggtagatccaaaaaagaagagaaaggtagatacggccgcatag

SEQ ID NO: 6 - DNA, 4326 bp, Streptococcus pyogenes
atggacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggctgctatcgtgccccagtcttttctcaaagatgattctattgataataaagtgttgacaagatccgataaagctagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagatga

SEQ ID NO: 7 - DNA, 4359 bp, Streptococcus pyogenes
atgcccaagaagaagaggaaggtgggaagggggatggacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggctgctatcgtgccccagtcttttctcaaagatgattctattgataataaagtgttgacaagatccgataaagctagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagatga

SEQ ID NO: 8 - protein, 1409 aa, Streptococcus thermophiles
MLFNKCIIISINLDFSNKEKCMTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 9 - DNA, 4167 bp, Streptococcus thermophiles
atgactaagccatactcaattggacttgatattggaacgaatagtgttggatgggctgtaataactgataattacaaggttccgtctaaaaaaatgaaagtcttaggaaatacgagtaaaaagtatatcaaaaagaacctgttaggtgtattactctttgactctggaatcacagcagaaggaagaagattgaagcgtactgcaagaagacgttatactagacgccgtaatcgtatcctttatttgcaggaaatttttagcacggagatggctacattagatgatgctttctttcaaagacttgacgattcgtttttagttcctgatgataaacgtgatagtaagtatccgatatttggaaacttagtagaagaaaaagtctatcatgatgaatttccaactatctatcatttaaggaaatatttagcagatagtactaaaaaagcagatttgcgtctagtttatcttgcattggctcatatgattaaatatagaggtcacttcttaattgaaggagagtttaattcaaaaaataatgatattcagaagaattttcaagactttttggacacttataatgctatttttgaatcggatttatcacttgagaatagtaaacaacttgaggaaattgttaaagataagattagtaaattagaaaagaaagatcgtattttaaaactcttccctggggagaagaattcggggattttttcagagtttctaaagttgattgtaggaaatcaagctgattttaggaaatgttttaatttagacgaaaaagcctccttacatttttccaaagaaagctatgatgaagatttagagactttgttaggttatattggagatgattacagtgatgtctttctcaaagcaaagaaactttatgatgctattcttttatcgggttttctgactgtaactgataatgagacagaagcacctctctcttctgctatgataaagcgatataatgaacacaaagaagatttagcgttactaaaggaatatataagaaatatttcactaaaaacgtataatgaagtatttaaagatgacaccaaaaatggttatgctggttatattgatggaaaaacaaatcaggaagatttctacgtatatctaaaaaacctattggctgaatttgaaggtgcggattattttcttgaaaaaattgatcgagaagattttttgagaaagcaacgtacatttgacaatggttcgataccatatcagattcatcttcaagaaatgagagcaattcttgataagcaagctaaattttatcctttcttggctaaaaataaagaaagaatcgagaagattttaaccttccgaattccttattatgtaggtccacttgcgagagggaatagtgattttgcctggtcaataagaaaacgaaatgaaaaaattacaccttggaattttgaggacgttattgacaaagaatcttcggcagaggctttcattaatcgaatgactagttttgatttgtatttgccagaagagaaggtacttccaaagcatagtctcttatacgaaacttttaatgtatataatgaattaacaaaagttagatttattgccgaaagtatgagagattatcaatttttagatagtaagcagaagaaagatattgttagactttattttaaagataaaaggaaagttactgataaggatattattgaatatttacatgcaatttatgggtatgatggaattgaattaaaaggcatagagaaacagtttaattctagtttatctacttatcacgatcttttaaatattattaatgataaagagtttttggatgatagttcaaatgaagcgattatcgaagaaattatccatactttgacaatttttgaagatagagagatgataaaacaacgtctttcaaaatttgagaatatattcgataaatccgttttgaaaaagttatctcgtagacattacactggctggggtaagttatctgctaagcttattaatggtattcgagatgaaaaatctggtaatactattcttgattacttaattgatgatggtatttctaaccgtaatttcatgcaacttattcacgatgatgctctttcttttaaaaagaagatacagaaagcacaaattattggtgacgaagataaaggtaatattaaagaggtcgttaagtctttgccaggtagtcctgcgattaaaaaaggtattttacaaagcataaaaattgtagatgaattggtcaaagtaatgggaggaagaaaacccgagtcaattgttgttgagatggctcgtgaaaatcaatataccaatcaaggtaagtctaattcccaacaacgcttgaaacgtttagaaaaatctctcaaagagttaggtagtaagatacttaaggaaaatattcctgcaaaactttctaaaatagacaataacgcacttcaaaatgatcgactttacttatactatcttcaaaatggaaaagatatgtataccggagatgatttagatattgatagattaagtaattatgatattgatcatattattcctcaagcttttttgaaagataattctattgacaataaagtacttgtttcatctgctagtaaccgtggtaaatcagatgattttccaagtttagaggttgtcaaaaaaagaaagacattttggtatcaattattgaaatcaaaattaatttctcaacgaaaatttgataatctgacaaaagctgaacggggaggattgttacctgaggacaaagctggttttattcaacgccagttggttgaaacacgtcaaataacaaaacatgtagctcgtttacttgatgagaaatttaataataaaaaagatgaaaataatagagcggtacgaacagtaaaaattattaccttgaaatctaccttagtttctcaatttcgtaaggattttgaactttataaagttcgtgaaatcaatgattttcatcatgctcatgatgcttacttgaatgccgttatagcaagtgctttacttaagaaataccctaaactagagccagaatttgtgtacggtgattatccaaaatacaatagttttagagaaagaaagtccgctacagaaaaggtatatttctattcaaatatcatgaatatctttaaaaaatctatttctttagctgatggtagagttattgaaagaccacttattgaggtaaatgaggagaccggcgaatccgtttggaataaagaatctgatttagcaactgtaaggagagtactctcttatccgcaagtaaatgttgtgaaaaaagttgaggaacagaatcacggattggatagaggaaaaccaaagggattgtttaatgcaaatctttcctcaaagccaaaaccaaatagtaatgaaaatttagtaggtgctaaagagtatcttgaccccaaaaagtatggggggtatgctggaatttctaattcttttgctgttcttgttaaagggacaattgaaaaaggtgctaagaaaaaaataacaaatgtactagaatttcaaggtatttctattttagataggattaattatagaaaagataaacttaattttttacttgaaaaaggttataaagatattgagttaattattgaactacctaaatatagtttatttgaactttcagatggttcacgtcgtatgttggctagtattttgtcaacgaataataagaggggagagattcacaaaggaaatcagatttttctttcacagaagtttgtgaaattactttatcatgctaagagaataagtaacacaattaatgagaatcatagaaaatatgttgagaaccataaaaaagagtttgaagaattattttactacattcttgagtttaatgagaattatgttggagctaaaaagaatggtaaacttttaaactctgcctttcaatcttggcaaaatcatagtatagatgaactctgtagtagttttataggacctaccggaagtgaaagaaaggggctatttgaattaacctctcgtggaagtgctgctgattttgaatttttaggtgttaaaattccaaggtatagagactataccccatcatccctattaaaagatgccacacttattcatcaatctgttacaggcctctatgaaacacgaatagaccttgccaaactaggagagggttaa

SEQ ID NO: 10 - DNA, 3366 bp, Streptococcus thermophilus
atgagcgacctggtgctgggcctggacatcggcatcggcagcgtgggcgtgggcatcctgaacaaggtgaccggcgagatcatccacaagaacagtcgcatcttccctgctgctcaggctgagaacaacctggtgcgccgcaccaaccgccagggtcgccggcttgctcgccgcaagaagcaccggcgcgtgcgcctgaaccgcctgttcgaggagagcggcctgatcaccgacttcaccaagatcagcatcaacctgaacccctaccagctgcgcgtgaagggcctgaccgacgagctgagcaacgaggagctgttcatcgccctgaagaacatggtgaagcaccgcggcatcagctacctggacgacgccagcgacgacggcaacagcagcgtgggcgactacgcccagatcgtgaaggagaacagcaagcagctggagaccaagacccccggccagatccagctggagcgctaccagacctacggccagctgcgcggcgacttcaccgtggagaaggacggcaagaagcaccgcctgatcaacgtgttccccaccagcgcctaccgcagcgaggccctgcgcatcctgcagacccagcaggagttcaacccccagatcaccgacgagttcatcaaccgctacctggagatcctgaccggcaagcgcaagtactaccacggccccggcaacgagaagagccgcaccgactacggccgctaccgcaccagcggcgagaccctggacaacatcttcggcatcctgatcggcaagtgcaccttctaccccgacgagttccgcgccgccaaggccagctacaccgcccaggagttcaacctgctgaacgacctgaacaacctgaccgtgcccaccgagaccaagaagctgagcaaggagcagaagaaccagatcatcaactacgtgaagaacgagaaggccatgggccccgccaagctgttcaagtacatcgccaagctgctgagctgcgacgtggccgacatcaagggctaccgcatcgacaagagcggcaaggccgagatccacaccttcgaggcctaccgcaagatgaagaccctggagaccctggacatcgagcagatggaccgcgagaccctggacaagctggcctacgtgctgaccctgaacaccgagcgcgagggcatccaggaggccctggagcacgagttcgccgacggcagcttcagccagaagcaggtggacgagctggtgcagttccgcaaggccaacagcagcatcttcggcaagggctggcacaacttcagcgtgaagctgatgatggagctgatccccgagctgtacgagaccagcgaggagcagatgaccatcctgacccgcctgggcaagcagaagaccaccagcagcagcaacaagaccaagtacatcgacgagaagctgctgaccgaggagatctacaaccccgtggtggccaagagcgtgcgccaggccatcaagatcgtgaacgccgccatcaaggagtacggcgacttcgacaacatcgtgatcgagatggcccgcgagaccaacgaggacgacgagaagaaggccatccagaagatccagaaggccaacaaggacgagaaggacgccgccatgctgaaggccgccaaccagtacaacggcaaggccgagctgccccacagcgtgttccacggccacaagcagctggccaccaagatccgcctgtggcaccagcagggcgagcgctgcctgtacaccggcaagaccatcagcatccacgacctgatcaacaacagcaaccagttcgaggtggaccacatcctgcccctgagcatcaccttcgacgacagcctggccaacaaggtgctggtgtacgccaccgccaaccaggagaagggccagcgcaccccctaccaggccctggacagcatggacgacgcctggagcttccgcgagctgaaggccttcgtgcgcgagagcaagaccctgagcaacaagaagaaggagtacctgctgaccgaggaggacatcagcaagttcgacgtgcgcaagaagttcatcgagcgcaacctggtggacacccgctacgccagccgcgtggtgctgaacgccctgcaggagcacttccgcgcccacaagatcgacaccaaggtgagcgtggtgcgcggccagttcaccagccagctgcgccgccactggggcatcgagaagacccgcgacacctaccaccaccacgccgtggacgccctgatcattgcggcttctagccagctgaacctgtggaagaagcagaagaacaccctggtgagctacagcgaggaccagctgctggacatcgagaccggcgagctgatcagcgacgacgagtacaaggagagcgtgttcaaggccccctaccagcacttcgtggacaccctgaagagcaaggagttcgaggacagcatcctgttcagctaccaggtggacagcaagttcaaccgcaagatcagcgacgccaccatctacgccacccgccaggccaaggtgggcaaggacaaggccgacgagacctacgtgctgggcaagatcaaggacatctacacccaggacggctacgacgccttcatgaagatctacaagaaggacaagagcaagttcctgatgtaccgccacgacccccagaccttcgagaaggtgatcgagcccatcctggagaactaccccaacaagcagatcaacgataaaggcaaggaggtgccctgcaaccccttcctgaagtacaaggaggagcacggctacatccgcaagtacagcaagaagggcaacggccccgagatcaagagcctgaagtactacgacagcaagctgggcaaccacatcgacatcacccccaaggacagcaacaacaaggtggtgctgcagagcgtgagcccctggcgcgccgacgtgtacttcaacaagaccaccggcaagtacgagatcctgggcctgaagtacgccgacctgcagtttgataagggcaccggcacctacaagatcagccaggagaagtacaacgacatcaagaagaaggagggcgtggacagcgacagcgagttcaagttcaccctgtacaagaacgaccttctgctggtgaaggacaccgagaccaaggagcaacagctgttccgcttcctgagccgcaccatgcccaagcagaagcactacgtggagctgaagccctacgacaagcagaagttcgagggcggcgaggccctgatcaaggtgctgggcaacgtggccaacagcggccagtgcaagaagggcctgggcaagagcaacatcagcatctacaaggtgcgcaccgacgtgctgggcaaccagcacatcatcaagaacgagggcgacaagcccaagctggacttctaa

SEQ ID NO: 11 - DNA, 3366 bp, Streptococcus thermophilus
atgagcgacctggtgctgggcctggccatcggcatcggcagcgtgggcgtgggcatcctgaacaaggtgaccggcgagatcatccacaagaacagtcgcatcttccctgctgctcaggctgagaacaacctggtgcgccgcaccaaccgccagggtcgccggcttgctcgccgcaagaagcaccggcgcgtgcgcctgaaccgcctgttcgaggagagcggcctgatcaccgacttcaccaagatcagcatcaacctgaacccctaccagctgcgcgtgaagggcctgaccgacgagctgagcaacgaggagctgttcatcgccctgaagaacatggtgaagcaccgcggcatcagctacctggacgacgccagcgacgacggcaacagcagcgtgggcgactacgcccagatcgtgaaggagaacagcaagcagctggagaccaagacccccggccagatccagctggagcgctaccagacctacggccagctgcgcggcgacttcaccgtggagaaggacggcaagaagcaccgcctgatcaacgtgttccccaccagcgcctaccgcagcgaggccctgcgcatcctgcagacccagcaggagttcaacccccagatcaccgacgagttcatcaaccgctacctggagatcctgaccggcaagcgcaagtactaccacggccccggcaacgagaagagccgcaccgactacggccgctaccgcaccagcggcgagaccctggacaacatcttcggcatcctgatcggcaagtgcaccttctaccccgacgagttccgcgccgccaaggccagctacaccgcccaggagttcaacctgctgaacgacctgaacaacctgaccgtgcccaccgagaccaagaagctgagcaaggagcagaagaaccagatcatcaactacgtgaagaacgagaaggccatgggccccgccaagctgttcaagtacatcgccaagctgctgagctgcgacgtggccgacatcaagggctaccgcatcgacaagagcggcaaggccgagatccacaccttcgaggcctaccgcaagatgaagaccctggagaccctggacatcgagcagatggaccgcgagaccctggacaagctggcctacgtgctgaccctgaacaccgagcgcgagggcatccaggaggccctggagcacgagttcgccgacggcagcttcagccagaagcaggtggacgagctggtgcagttccgcaaggccaacagcagcatcttcggcaagggctggcacaacttcagcgtgaagctgatgatggagctgatccccgagctgtacgagaccagcgaggagcagatgaccatcctgacccgcctgggcaagcagaagaccaccagcagcagcaacaagaccaagtacatcgacgagaagctgctgaccgaggagatctacaaccccgtggtggccaagagcgtgcgccaggccatcaagatcgtgaacgccgccatcaaggagtacggcgacttcgacaacatcgtgatcgagatggcccgcgagaccaacgaggacgacgagaagaaggccatccagaagatccagaaggccaacaaggacgagaaggacgccgccatgctgaaggccgccaaccagtacaacggcaaggccgagctgccccacagcgtgttccacggccacaagcagctggccaccaagatccgcctgtggcaccagcagggcgagcgctgcctgtacaccggcaagaccatcagcatccacgacctgatcaacaacagcaaccagttcgaggtggctgccatcctgcccctgagcatcaccttcgacgacagcctggccaacaaggtgctggtgtacgccaccgccgctcaggagaagggccagcgcaccccctaccaggccctggacagcatggacgacgcctggagcttccgcgagctgaaggccttcgtgcgcgagagcaagaccctgagcaacaagaagaaggagtacctgctgaccgaggaggacatcagcaagttcgacgtgcgcaagaagttcatcgagcgcaacctggtggacacccgctacgccagccgcgtggtgctgaacgccctgcaggagcacttccgcgcccacaagatcgacaccaaggtgagcgtggtgcgcggccagttcaccagccagctgcgccgccactggggcatcgagaagacccgcgacacctaccaccaccacgccgtggacgccctgatcattgcggcttctagccagctgaacctgtggaagaagcagaagaacaccctggtgagctacagcgaggaccagctgctggacatcgagaccggcgagctgatcagcgacgacgagtacaaggagagcgtgttcaaggccccctaccagcacttcgtggacaccctgaagagcaaggagttcgaggacagcatcctgttcagctaccaggtggacagcaagttcaaccgcaagatcagcgacgccaccatctacgccacccgccaggccaaggtgggcaaggacaaggccgacgagacctacgtgctgggcaagatcaaggacatctacacccaggacggctacgacgccttcatgaagatctacaagaaggacaagagcaagttcctgatgtaccgccacgacccccagaccttcgagaaggtgatcgagcccatcctggagaactaccccaacaagcagatcaacgataaaggcaaggaggtgccctgcaaccccttcctgaagtacaaggaggagcacggctacatccgcaagtacagcaagaagggcaacggccccgagatcaagagcctgaagtactacgacagcaagctgggcaaccacatcgacatcacccccaaggacagcaacaacaaggtggtgctgcagagcgtgagcccctggcgcgccgacgtgtacttcaacaagaccaccggcaagtacgagatcctgggcctgaagtacgccgacctgcagtttgataagggcaccggcacctacaagatcagccaggagaagtacaacgacatcaagaagaaggagggcgtggacagcgacagcgagttcaagttcaccctgtacaagaacgaccttctgctggtgaaggacaccgagaccaaggagcaacagctgttccgcttcctgagccgcaccatgcccaagcagaagcactacgtggagctgaagccctacgacaagcagaagttcgagggcggcgaggccctgatcaaggtgctgggcaacgtggccaacagcggccagtgcaagaagggcctgggcaagagcaacatcagcatctacaaggtgcgcaccgacgtgctgggcaaccagcacatcatcaagaacgagggcgacaagcccaagctggacttctaa

SEQ ID NO: 12 - DNA, 3399 bp, Streptococcus thermophilus
atgagcgacctggtgctgggcctggacatcggcatcggcagcgtgggcgtgggcatcctgaacaaggtgaccggcgagatcatccacaagaacagtcgcatcttccctgctgctcaggctgagaacaacctggtgcgccgcaccaaccgccagggtcgccggcttgctcgccgcaagaagcaccggcgcgtgcgcctgaaccgcctgttcgaggagagcggcctgatcaccgacttcaccaagatcagcatcaacctgaacccctaccagctgcgcgtgaagggcctgaccgacgagctgagcaacgaggagctgttcatcgccctgaagaacatggtgaagcaccgcggcatcagctacctggacgacgccagcgacgacggcaacagcagcgtgggcgactacgcccagatcgtgaaggagaacagcaagcagctggagaccaagacccccggccagatccagctggagcgctaccagacctacggccagctgcgcggcgacttcaccgtggagaaggacggcaagaagcaccgcctgatcaacgtgttccccaccagcgcctaccgcagcgaggccctgcgcatcctgcagacccagcaggagttcaacccccagatcaccgacgagttcatcaaccgctacctggagatcctgaccggcaagcgcaagtactaccacggccccggcaacgagaagagccgcaccgactacggccgctaccgcaccagcggcgagaccctggacaacatcttcggcatcctgatcggcaagtgcaccttctaccccgacgagttccgcgccgccaaggccagctacaccgcccaggagttcaacctgctgaacgacctgaacaacctgaccgtgcccaccgagaccaagaagctgagcaaggagcagaagaaccagatcatcaactacgtgaagaacgagaaggccatgggccccgccaagctgttcaagtacatcgccaagctgctgagctgcgacgtggccgacatcaagggctaccgcatcgacaagagcggcaaggccgagatccacaccttcgaggcctaccgcaagatgaagaccctggagaccctggacatcgagcagatggaccgcgagaccctggacaagctggcctacgtgctgaccctgaacaccgagcgcgagggcatccaggaggccctggagcacgagttcgccgacggcagcttcagccagaagcaggtggacgagctggtgcagttccgcaaggccaacagcagcatcttcggcaagggctggcacaacttcagcgtgaagctgatgatggagctgatccccgagctgtacgagaccagcgaggagcagatgaccatcctgacccgcctgggcaagcagaagaccaccagcagcagcaacaagaccaagtacatcgacgagaagctgctgaccgaggagatctacaaccccgtggtggccaagagcgtgcgccaggccatcaagatcgtgaacgccgccatcaaggagtacggcgacttcgacaacatcgtgatcgagatggcccgcgagaccaacgaggacgacgagaagaaggccatccagaagatccagaaggccaacaaggacgagaaggacgccgccatgctgaaggccgccaaccagtacaacggcaaggccgagctgccccacagcgtgttccacggccacaagcagctggccaccaagatccgcctgtggcaccagcagggcgagcgctgcctgtacaccggcaagaccatcagcatccacgacctgatcaacaacagcaaccagttcgaggtggaccacatcctgcccctgagcatcaccttcgacgacagcctggccaacaaggtgctggtgtacgccaccgccaaccaggagaagggccagcgcaccccctaccaggccctggacagcatggacgacgcctggagcttccgcgagctgaaggccttcgtgcgcgagagcaagaccctgagcaacaagaagaaggagtacctgctgaccgaggaggacatcagcaagttcgacgtgcgcaagaagttcatcgagcgcaacctggtggacacccgctacgccagccgcgtggtgctgaacgccctgcaggagcacttccgcgcccacaagatcgacaccaaggtgagcgtggtgcgcggccagttcaccagccagctgcgccgccactggggcatcgagaagacccgcgacacctaccaccaccacgccgtggacgccctgatcattgcggcttctagccagctgaacctgtggaagaagcagaagaacaccctggtgagctacagcgaggaccagctgctggacatcgagaccggcgagctgatcagcgacgacgagtacaaggagagcgtgttcaaggccccctaccagcacttcgtggacaccctgaagagcaaggagttcgaggacagcatcctgttcagctaccaggtggacagcaagttcaaccgcaagatcagcgacgccaccatctacgccacccgccaggccaaggtgggcaaggacaaggccgacgagacctacgtgctgggcaagatcaaggacatctacacccaggacggctacgacgccttcatgaagatctacaagaaggacaagagcaagttcctgatgtaccgccacgacccccagaccttcgagaaggtgatcgagcccatcctggagaactaccccaacaagcagatcaacgataaaggcaaggaggtgccctgcaaccccttcctgaagtacaaggaggagcacggctacatccgcaagtacagcaagaagggcaacggccccgagatcaagagcctgaagtactacgacagcaagctgggcaaccacatcgacatcacccccaaggacagcaacaacaaggtggtgctgcagagcgtgagcccctggcgcgccgacgtgtacttcaacaagaccaccggcaagtacgagatcctgggcctgaagtacgccgacctgcagtttgataagggcaccggcacctacaagatcagccaggagaagtacaacgacatcaagaagaaggagggcgtggacagcgacagcgagttcaagttcaccctgtacaagaacgaccttctgctggtgaaggacaccgagaccaaggagcaacagctgttccgcttcctgagccgcaccatgcccaagcagaagcactacgtggagctgaagccctacgacaagcagaagttcgagggcggcgaggccctgatcaaggtgctgggcaacgtggccaacagcggccagtgcaagaagggcctgggcaagagcaacatcagcatctacaaggtgcgcaccgacgtgctgggcaaccagcacatcatcaagaacgagggcgacaagcccaagctggacttcagcagggctgaccccaagaagaagaggaaggtgtga

SEQ ID NO: 13 - DNA, 3459 bp, Streptococcus thermophilus
atgagcgacctggtgctgggcctggacatcggcatcggcagcgtgggcgtgggcatcctgaacaaggtgaccggcgagatcatccacaagaacagtcgcatcttccctgctgctcaggctgagaacaacctggtgcgccgcaccaaccgccagggtcgccggcttgctcgccgcaagaagcaccggcgcgtgcgcctgaaccgcctgttcgaggagagcggcctgatcaccgacttcaccaagatcagcatcaacctgaacccctaccagctgcgcgtgaagggcctgaccgacgagctgagcaacgaggagctgttcatcgccctgaagaacatggtgaagcaccgcggcatcagctacctggacgacgccagcgacgacggcaacagcagcgtgggcgactacgcccagatcgtgaaggagaacagcaagcagctggagaccaagacccccggccagatccagctggagcgctaccagacctacggccagctgcgcggcgacttcaccgtggagaaggacggcaagaagcaccgcctgatcaacgtgttccccaccagcgcctaccgcagcgaggccctgcgcatcctgcagacccagcaggagttcaacccccagatcaccgacgagttcatcaaccgctacctggagatcctgaccggcaagcgcaagtactaccacggccccggcaacgagaagagccgcaccgactacggccgctaccgcaccagcggcgagaccctggacaacatcttcggcatcctgatcggcaagtgcaccttctaccccgacgagttccgcgccgccaaggccagctacaccgcccaggagttcaacctgctgaacgacctgaacaacctgaccgtgcccaccgagaccaagaagctgagcaaggagcagaagaaccagatcatcaactacgtgaagaacgagaaggccatgggccccgccaagctgttcaagtacatcgccaagctgctgagctgcgacgtggccgacatcaagggctaccgcatcgacaagagcggcaaggccgagatccacaccttcgaggcctaccgcaagatgaagaccctggagaccctggacatcgagcagatggaccgcgagaccctggacaagctggcctacgtgctgaccctgaacaccgagcgcgagggcatccaggaggccctggagcacgagttcgccgacggcagcttcagccagaagcaggtggacgagctggtgcagttccgcaaggccaacagcagcatcttcggcaagggctggcacaacttcagcgtgaagctgatgatggagctgatccccgagctgtacgagaccagcgaggagcagatgaccatcctgacccgcctgggcaagcagaagaccaccagcagcagcaacaagaccaagtacatcgacgagaagctgctgaccgaggagatctacaaccccgtggtggccaagagcgtgcgccaggccatcaagatcgtgaacgccgccatcaaggagtacggcgacttcgacaacatcgtgatcgagatggcccgcgagaccaacgaggacgacgagaagaaggccatccagaagatccagaaggccaacaaggacgagaaggacgccgccatgctgaaggccgccaaccagtacaacggcaaggccgagctgccccacagcgtgttccacggccacaagcagctggccaccaagatccgcctgtggcaccagcagggcgagcgctgcctgtacaccggcaagaccatcagcatccacgacctgatcaacaacagcaaccagttcgaggtggaccacatcctgcccctgagcatcaccttcgacgacagcctggccaacaaggtgctggtgtacgccaccgccaaccaggagaagggccagcgcaccccctaccaggccctggacagcatggacgacgcctggagcttccgcgagctgaaggccttcgtgcgcgagagcaagaccctgagcaacaagaagaaggagtacctgctgaccgaggaggacatcagcaagttcgacgtgcgcaagaagttcatcgagcgcaacctggtggacacccgctacgccagccgcgtggtgctgaacgccctgcaggagcacttccgcgcccacaagatcgacaccaaggtgagcgtggtgcgcggccagttcaccagccagctgcgccgccactggggcatcgagaagacccgcgacacctaccaccaccacgccgtggacgccctgatcattgcggcttctagccagctgaacctgtggaagaagcagaagaacaccctggtgagctacagcgaggaccagctgctggacatcgagaccggcgagctgatcagcgacgacgagtacaaggagagcgtgttcaaggccccctaccagcacttcgtggacaccctgaagagcaaggagttcgaggacagcatcctgttcagctaccaggtggacagcaagttcaaccgcaagatcagcgacgccaccatctacgccacccgccaggccaaggtgggcaaggacaaggccgacgagacctacgtgctgggcaagatcaaggacatctacacccaggacggctacgacgccttcatgaagatctacaagaaggacaagagcaagttcctgatgtaccgccacgacccccagaccttcgagaaggtgatcgagcccatcctggagaactaccccaacaagcagatcaacgataaaggcaaggaggtgccctgcaaccccttcctgaagtacaaggaggagcacggctacatccgcaagtacagcaagaagggcaacggccccgagatcaagagcctgaagtactacgacagcaagctgggcaaccacatcgacatcacccccaaggacagcaacaacaaggtggtgctgcagagcgtgagcccctggcgcgccgacgtgtacttcaacaagaccaccggcaagtacgagatcctgggcctgaagtacgccgacctgcagtttgataagggcaccggcacctacaagatcagccaggagaagtacaacgacatcaagaagaaggagggcgtggacagcgacagcgagttcaagttcaccctgtacaagaacgaccttctgctggtgaaggacaccgagaccaaggagcaacagctgttccgcttcctgagccgcaccatgcccaagcagaagcactacgtggagctgaagccctacgacaagcagaagttcgagggcggcgaggccctgatcaaggtgctgggcaacgtggccaacagcggccagtgcaagaagggcctgggcaagagcaacatcagcatctacaaggtgcgcaccgacgtgctgggcaaccagcacatcatcaagaacgagggcgacaagcccaagctggacttcgcggccgcagatccaaaaaagaagagaaaggtagatccaaaaaagaagagaaaggtagatccaaaaaagaagagaaaggtagatacggccgcatag

SEQ ID NO: 14 - DNA, 3585 bp, Streptococcus thermophilus
atgagcgacctggtgctgggcctggccatcggcatcggcagcgtgggcgtgggcatcctgaacaaggtgaccggcgagatcatccacaagaacagtcgcatcttccctgctgctcaggctgagaacaacctggtgcgccgcaccaaccgccagggtcgccggcttgctcgccgcaagaagcaccggcgcgtgcgcctgaaccgcctgttcgaggagagcggcctgatcaccgacttcaccaagatcagcatcaacctgaacccctaccagctgcgcgtgaagggcctgaccgacgagctgagcaacgaggagctgttcatcgccctgaagaacatggtgaagcaccgcggcatcagctacctggacgacgccagcgacgacggcaacagcagcgtgggcgactacgcccagatcgtgaaggagaacagcaagcagctggagaccaagacccccggccagatccagctggagcgctaccagacctacggccagctgcgcggcgacttcaccgtggagaaggacggcaagaagcaccgcctgatcaacgtgttccccaccagcgcctaccgcagcgaggccctgcgcatcctgcagacccagcaggagttcaacccccagatcaccgacgagttcatcaaccgctacctggagatcctgaccggcaagcgcaagtactaccacggccccggcaacgagaagagccgcaccgactacggccgctaccgcaccagcggcgagaccctggacaacatcttcggcatcctgatcggcaagtgcaccttctaccccgacgagttccgcgccgccaaggccagctacaccgcccaggagttcaacctgctgaacgacctgaacaacctgaccgtgcccaccgagaccaagaagctgagcaaggagcagaagaaccagatcatcaactacgtgaagaacgagaaggccatgggccccgccaagctgttcaagtacatcgccaagctgctgagctgcgacgtggccgacatcaagggctaccgcatcgacaagagcggcaaggccgagatccacaccttcgaggcctaccgcaagatgaagaccctggagaccctggacatcgagcagatggaccgcgagaccctggacaagctggcctacgtgctgaccctgaacaccgagcgcgagggcatccaggaggccctggagcacgagttcgccgacggcagcttcagccagaagcaggtggacgagctggtgcagttccgcaaggccaacagcagcatcttcggcaagggctggcacaacttcagcgtgaagctgatgatggagctgatccccgagctgtacgagaccagcgaggagcagatgaccatcctgacccgcctgggcaagcagaagaccaccagcagcagcaacaagaccaagtacatcgacgagaagctgctgaccgaggagatctacaaccccgtggtggccaagagcgtgcgccaggccatcaagatcgtgaacgccgccatcaaggagtacggcgacttcgacaacatcgtgatcgagatggcccgcgagaccaacgaggacgacgagaagaaggccatccagaagatccagaaggccaacaaggacgagaaggacgccgccatgctgaaggccgccaaccagtacaacggcaaggccgagctgccccacagcgtgttccacggccacaagcagctggccaccaagatccgcctgtggcaccagcagggcgagcgctgcctgtacaccggcaagaccatcagcatccacgacctgatcaacaacagcaaccagttcgaggtggctgccatcctgcccctgagcatcaccttcgacgacagcctggccaacaaggtgctggtgtacgccaccgccgctcaggagaagggccagcgcaccccctaccaggccctggacagcatggacgacgcctggagcttccgcgagctgaaggccttcgtgcgcgagagcaagaccctgagcaacaagaagaaggagtacctgctgaccgaggaggacatcagcaagttcgacgtgcgcaagaagttcatcgagcgcaacctggtggacacccgctacgccagccgcgtggtgctgaacgccctgcaggagcacttccgcgcccacaagatcgacaccaaggtgagcgtggtgcgcggccagttcaccagccagctgcgccgccactggggcatcgagaagacccgcgacacctaccaccaccacgccgtggacgccctgatcattgcggcttctagccagctgaacctgtggaagaagcagaagaacaccctggtgagctacagcgaggaccagctgctggacatcgagaccggcgagctgatcagcgacgacgagtacaaggagagcgtgttcaaggccccctaccagcacttcgtggacaccctgaagagcaaggagttcgaggacagcatcctgttcagctaccaggtggacagcaagttcaaccgcaagatcagcgacgccaccatctacgccacccgccaggccaaggtgggcaaggacaaggccgacgagacctacgtgctgggcaagatcaaggacatctacacccaggacggctacgacgccttcatgaagatctacaagaaggacaagagcaagttcctgatgtaccgccacgacccccagaccttcgagaaggtgatcgagcccatcctggagaactaccccaacaagcagatcaacgataaaggcaaggaggtgccctgcaaccccttcctgaagtacaaggaggagcacggctacatccgcaagtacagcaagaagggcaacggccccgagatcaagagcctgaagtactacgacagcaagctgggcaaccacatcgacatcacccccaaggacagcaacaacaaggtggtgctgcagagcgtgagcccctggcgcgccgacgtgtacttcaacaagaccaccggcaagtacgagatcctgggcctgaagtacgccgacctgcagtttgataagggcaccggcacctacaagatcagccaggagaagtacaacgacatcaagaagaaggagggcgtggacagcgacagcgagttcaagttcaccctgtacaagaacgaccttctgctggtgaaggacaccgagaccaaggagcaacagctgttccgcttcctgagccgcaccatgcccaagcagaagcactacgtggagctgaagccctacgacaagcagaagttcgagggcggcgaggccctgatcaaggtgctgggcaacgtggccaacagcggccagtgcaagaagggcctgggcaagagcaacatcagcatctacaaggtgcgcaccgacgtgctgggcaaccagcacatcatcaagaacgagggcgacaagcccaagctggacttcagcagggctgaccccaagaagaagaggaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagatga

SEQ ID NO: 15 - DNA, 3606 bp, Streptococcus thermophilus
atgcccaagaagaagaggaaggtgagcgacctggtgctgggcctggccatcggcatcggcagcgtgggcgtgggcatcctgaacaaggtgaccggcgagatcatccacaagaacagtcgcatcttccctgctgctcaggctgagaacaacctggtgcgccgcaccaaccgccagggtcgccggcttgctcgccgcaagaagcaccggcgcgtgcgcctgaaccgcctgttcgaggagagcggcctgatcaccgacttcaccaagatcagcatcaacctgaacccctaccagctgcgcgtgaagggcctgaccgacgagctgagcaacgaggagctgttcatcgccctgaagaacatggtgaagcaccgcggcatcagctacctggacgacgccagcgacgacggcaacagcagcgtgggcgactacgcccagatcgtgaaggagaacagcaagcagctggagaccaagacccccggccagatccagctggagcgctaccagacctacggccagctgcgcggcgacttcaccgtggagaaggacggcaagaagcaccgcctgatcaacgtgttccccaccagcgcctaccgcagcgaggccctgcgcatcctgcagacccagcaggagttcaacccccagatcaccgacgagttcatcaaccgctacctggagatcctgaccggcaagcgcaagtactaccacggccccggcaacgagaagagccgcaccgactacggccgctaccgcaccagcggcgagaccctggacaacatcttcggcatcctgatcggcaagtgcaccttctaccccgacgagttccgcgccgccaaggccagctacaccgcccaggagttcaacctgctgaacgacctgaacaacctgaccgtgcccaccgagaccaagaagctgagcaaggagcagaagaaccagatcatcaactacgtgaagaacgagaaggccatgggccccgccaagctgttcaagtacatcgccaagctgctgagctgcgacgtggccgacatcaagggctaccgcatcgacaagagcggcaaggccgagatccacaccttcgaggcctaccgcaagatgaagaccctggagaccctggacatcgagcagatggaccgcgagaccctggacaagctggcctacgtgctgaccctgaacaccgagcgcgagggcatccaggaggccctggagcacgagttcgccgacggcagcttcagccagaagcaggtggacgagctggtgcagttccgcaaggccaacagcagcatcttcggcaagggctggcacaacttcagcgtgaagctgatgatggagctgatccccgagctgtacgagaccagcgaggagcagatgaccatcctgacccgcctgggcaagcagaagaccaccagcagcagcaacaagaccaagtacatcgacgagaagctgctgaccgaggagatctacaaccccgtggtggccaagagcgtgcgccaggccatcaagatcgtgaacgccgccatcaaggagtacggcgacttcgacaacatcgtgatcgagatggcccgcgagaccaacgaggacgacgagaagaaggccatccagaagatccagaaggccaacaaggacgagaaggacgccgccatgctgaaggccgccaaccagtacaacggcaaggccgagctgccccacagcgtgttccacggccacaagcagctggccaccaagatccgcctgtggcaccagcagggcgagcgctgcctgtacaccggcaagaccatcagcatccacgacctgatcaacaacagcaaccagttcgaggtggctgccatcctgcccctgagcatcaccttcgacgacagcctggccaacaaggtgctggtgtacgccaccgccgctcaggagaagggccagcgcaccccctaccaggccctggacagcatggacgacgcctggagcttccgcgagctgaaggccttcgtgcgcgagagcaagaccctgagcaacaagaagaaggagtacctgctgaccgaggaggacatcagcaagttcgacgtgcgcaagaagttcatcgagcgcaacctggtggacacccgctacgccagccgcgtggtgctgaacgccctgcaggagcacttccgcgcccacaagatcgacaccaaggtgagcgtggtgcgcggccagttcaccagccagctgcgccgccactggggcatcgagaagacccgcgacacctaccaccaccacgccgtggacgccctgatcattgcggcttctagccagctgaacctgtggaagaagcagaagaacaccctggtgagctacagcgaggaccagctgctggacatcgagaccggcgagctgatcagcgacgacgagtacaaggagagcgtgttcaaggccccctaccagcacttcgtggacaccctgaagagcaaggagttcgaggacagcatcctgttcagctaccaggtggacagcaagttcaaccgcaagatcagcgacgccaccatctacgccacccgccaggccaaggtgggcaaggacaaggccgacgagacctacgtgctgggcaagatcaaggacatctacacccaggacggctacgacgccttcatgaagatctacaagaaggacaagagcaagttcctgatgtaccgccacgacccccagaccttcgagaaggtgatcgagcccatcctggagaactaccccaacaagcagatcaacgataaaggcaaggaggtgccctgcaaccccttcctgaagtacaaggaggagcacggctacatccgcaagtacagcaagaagggcaacggccccgagatcaagagcctgaagtactacgacagcaagctgggcaaccacatcgacatcacccccaaggacagcaacaacaaggtggtgctgcagagcgtgagcccctggcgcgccgacgtgtacttcaacaagaccaccggcaagtacgagatcctgggcctgaagtacgccgacctgcagtttgataagggcaccggcacctacaagatcagccaggagaagtacaacgacatcaagaagaaggagggcgtggacagcgacagcgagttcaagttcaccctgtacaagaacgaccttctgctggtgaaggacaccgagaccaaggagcaacagctgttccgcttcctgagccgcaccatgcccaagcagaagcactacgtggagctgaagccctacgacaagcagaagttcgagggcggcgaggccctgatcaaggtgctgggcaacgtggccaacagcggccagtgcaagaagggcctgggcaagagcaacatcagcatctacaaggtgcgcaccgacgtgctgggcaaccagcacatcatcaagaacgagggcgacaagcccaagctggacttcagcagggctgaccccaagaagaagaggaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagatga

SEQ ID NO: 16 - DNA, 3366 bp, Streptococcus thermophilus
atgagtgacttagttttaggacttgatatcggtataggttctgttggtgtaggtatccttaacaaagtgacaggagaaattatccataaaaactcacgcatcttcccagcagctcaagcggaaaataacctagtacgtagaacgaatcgtcaaggaagacgcttgacacgacgtaaaaaacatcgtagagttcgtttaaatcgtctatttgaggaaagtggattaatcaccgattttacgaagatttcaattaatcttaacccatatcaattacgagttaagggcttgaccgatgaattgtctaatgaagaactgtttatcgctcttaaaaatatggtgaaacaccgtgggattagttacctcgatgatgctagtgatgacggaaattcatcaataggagactatgcacaaattgttaaggaaaatagtaaacaattagaaactaagacaccgggacagatacagttggaacgctaccaaacatatggtcaattacgtggtgattttactgttgagaaagatggcaaaaaacatcgcttgattaatgtctttccaacatcagcttatcgttcagaagccttaaggatactgcaaactcaacaagaatttaatccacagattacagatgaatttattaatcgttatctcgaaattttaactggaaaacggaaatattatcatggacccggaaatgaaaagtcacggactgattatggtcgttacagaacgagtggagaaactttagacaatatttttggaattctaattgggaaatgtacattttatccagacgagtttagagcagcaaaagcttcctacacggctcaagaattcaatttgctaaatgatttgaacaatctaacagttcctactgaaaccaaaaagttgagcaaagaacagaagaatcaaatcattaattatgtcaaaaatgaaaaggcaatggggccagcgaaactttttaaatatatcgctaagttactttcttgtgatgttgcagatatcaagggataccgtatcgacaaatcaggtaaggctgagattcatactttcgaagcctatcgaaaaatgaaaacgcttgaaaccttagatattgagcaaatggatagagaaacgcttgataaattagcctatgtcttaacattaaacactgagagggaaggtattcaagaagccttagaacatgaatttgctgatggtagctttagccagaagcaagttgacgaattggttcaattccgcaaagcaaatagttccatttttggaaaaggatggcataatttttctgtcaaactgatgatggagttaattccagaattgtatgagacgtcagaagagcaaatgactatcctaacacgacttggaaaacaaaaaacgacttcgtcttcaaataaaacaaaatatatagatgaaaaactattaactgaagaaatctataatcctgttgttgctaagtctgttcgccaggctataaaaatcgtaaatgcggcgattaaagaatacggagactttgacaatattgtcatcgaaatggctcgtgaaacaaatgaagatgatgaaaagaaagctattcaaaagattcaaaaagccaacaaagatgaaaaagatgcagcaatgcttaaggctgctaaccaatataatggaaaggctgaattaccacatagtgttttccacggtcataagcaattagcgactaaaatccgcctttggcatcagcaaggagaacgttgcctttatactggtaagacaatctcaatccatgatttgataaataattctaatcagtttgaagtagatcatattttacctctttctatcacattcgatgatagccttgcaaataaggttttggtttatgcaactgctaaccaagaaaaaggacaacgaacaccttatcaggctttagatagtatggatgatgcgtggtctttccgtgaattaaaagcttttgtacgtgagtcaaaaacactttcgaacaagaaaaaagaatacctccttacagaagaagatatttcaaagtttgatgttcgaaagaaatttattgaacgaaatcttgtagatacaagatacgcttcaagagttgtcctcaatgcccttcaagaacactttagagctcacaagattgatacaaaagtttccgtggttcgtggccaatttacatctcaattgagacgccattggggaattgagaagactcgtgatacttatcatcaccatgctgtcgatgcattgattattgccgcctcaagtcagttgaatttgtggaaaaaacaaaagaatacccttgtaagttattcagaagaccaactccttgatattgaaacaggtgaacttattagtgatgatgagtacaaggaatctgtgttcaaagccccttatcaacattttgttgatacattgaagagtaaagaatttgaagacagtatcttattctcttatcaagtggattctaagtttaatcgtaaaatatcagatgccactatttatgcgacaagacaggctaaagtaggaaaagataaggcggatgaaacttatgtcttagggaaaatcaaagatatttatactcaggatggttatgatgcctttatgaagatttataagaaggataagtcaaaattcctcatgtatcgtcacgacccacaaacctttgagaaagttatcgagccaattttagagaactatcctaataagcaaataaatgaaaaagggaaagaggtaccatgtaatcctttcctaaaatataaagaagaacatggctatattcgtaaatatagtaaaaaaggcaatggtcctgaaatcaagagtcttaaatactatgatagtaagctaggcaatcatattgatattactccgaaggatagtaacaataaagttgtcttacagtcagtttctccatggagagcggatgtctatttcaataagactactggaaaatacgaaatcctcggattgaaatatgctgatttacaatttgaaaaagggacaggaacatataagatttcccaggaaaaatacaatgacattaagaaaaaagagggtgtagattctgattcagaattcaagtttacactttataaaaatgatttgttactcgttaaagatacagaaacaaaagaacaacagcttttccgttttctttctcgaactatgcctaaacaaaagcattatgttgaattaaaaccttatgataaacagaaatttgaaggaggtgaggcgttaattaaagtgttgggtaacgttgctaatagtggtcaatgcaaaaaagggctaggaaaatcaaatatttctatttataaggtaagaacagatgtcctaggaaatcagcatatcatcaaaaatgagggtgataagcctaagctagatttttaa

SEQ ID NO: 17 - DNA, 4167 bp, Streptococcus thermophilus; identical to SEQ ID NO: 9

SEQ ID NO: 18 - DNA, 3249 bp, Neisseria meningitidis
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 19 - DNA, 3249 bp, Neisseria meningitidis
atggccgccttcaagcccaaccccatcaactacatcctgggcctggccatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgccgctgccctgcccttcagccgcacctgggacgacagcttcaacaacaaggtgctggtgctgggcagcgaggctcagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 20 - DNA, 3282 bp, Neisseria meningitidis
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgcagcagggctgaccccaagaagaagaggaaggtgtga

SEQ ID NO: 21 - DNA, 3342 bp, Neisseria meningitidis
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgcgcggccgcagatccaaaaaagaagagaaaggtagatccaaaaaagaagagaaaggtagatccaaaaaagaagagaaaggtagatacggccgcatag

SEQ ID NO: 22 - DNA, 3468 bp, Neisseria meningitidis
atggccgccttcaagcccaaccccatcaactacatcctgggcctggccatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgccgctgccctgcccttcagccgcacctgggacgacagcttcaacaacaaggtgctggtgctgggcagcgaggctcagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgcagcagggctgaccccaagaagaagaggaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagatga

SEQ ID NO: 23 - DNA, 3489 bp, Neisseria meningitidis
atgcccaagaagaagaggaaggtggccgccttcaagcccaaccccatcaactacatcctgggcctggccatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgccgctgccctgcccttcagccgcacctgggacgacagcttcaacaacaaggtgctggtgctgggcagcgaggctcagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgcagcagggctgaccccaagaagaagaggaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagatga

SEQ ID NO: 24 - DNA, 3249 bp, Neisseria meningitidis
atggctgccttcaaacctaattcaatcaactacatcctcggcctcgatatcggcatcgcatccgtcggctgggcgatggtagaaattgacgaagaagaaaaccccatccgcctgattgatttgggcgtgcgcgtatttgagcgtgccgaagtaccgaaaacaggcgactcccttgccatggcaaggcgtttggcgcgcagtgttcgccgcctgacccgccgtcgcgcccaccgcctgcttcggacccgccgcctattgaaacgcgaaggcgtattacaagccgccaattttgacgaaaacggcttgattaaatccttaccgaatacaccatggcaacttcgcgcagccgcattagaccgcaaactgacgcctttagagtggtcggcagtcttgttgcatttaatcaaacatcgcggctatttatcgcaacggaaaaacgagggcgaaactgccgataaggagcttggcgctttgcttaaaggcgtagccggcaatgcccatgccttacagacaggcgatttccgcacaccggccgaattggctttaaataaatttgagaaagaaagcggccatatccgcaatcagcgcagcgattattcgcatacgttcagccgcaaagatttacaggcggagctgattttgctgtttgaaaaacaaaaagaatttggcaatccgcatgtttcaggcggccttaaagaaggtattgaaaccctactgatgacgcaacgccctgccctgtccggcgatgccgttcaaaaaatgttggggcattgcaccttcgaaccggcagagccgaaagccgctaaaaacacctacacagccgaacgtttcatctggctgaccaagctgaacaacctgcgtattttagagcaaggcagcgagcggccattgaccgataccgaacgcgccacgcttatggacgagccatacagaaaatccaaactgacttacgcacaagcccgtaagctgctgggtttagaagataccgcctttttcaaaggcttgcgctatggtaaagacaatgccgaagcctcaacattgatggaaatgaaggcctaccatgccatcagccgtgcactggaaaaagaaggattgaaagacaaaaaatccccattaaacctttctcccgaattacaagacgaaatcggcacggcattctccctgttcaaaaccgatgaagacattacaggccgtctgaaagaccgtatacagcccgaaatcttagaagcgctgttgaaacacatcagcttcgataagttcgtccaaatttccttgaaagcattgcgccgaattgtgcctctaatggaacaaggcaaacgttacgatgaagcctgcgccgaaatctacggagaccattacggcaagaagaatacggaagaaaagatttatctgccgccgattcccgccgacgaaatccgcaaccccgtcgtcttgcgcgccttatctcaagcacgtaaggtcattaacggcgtggtacgccgttacggctccccagctcgtatccatattgaaactgcaagggaagtaggtaaatcgtttaaagaccgcaaagaaattgagaaacgccaagaagaaaaccgcaaagaccgggaaaaagccgccgccaaattccgagagtatttccccaattttgtcggagaacccaaatccaaagatattctgaaactgcgcctgtacgagcaacaacacggcaaatgcctgtattcgggcaaagaaatcaacttaggccgtctgaacgaaaaaggctatgtcgaaatcgaccatgccctgccgttctcgcgcacatgggacgacagtttcaacaataaagtactggtattgggcagcgaaaaccaaaacaaaggcaatcaaaccccttacgaatacttcaacggcaaagacaacagccgcgaatggcaggaatttaaagcgcgtgtcgaaaccagccgtttcccgcgcagtaaaaaacaacggattctgctgcaaaaattcgatgaagacggctttaaagaacgcaatctgaacgacacgcgctacgtcaaccgtttcctgtgtcaatttgttgccgaccgtatgcggctgacaggtaaaggcaagaaacgtgtctttgcatccaacggacaaattaccaatctgttgcgcggcttttggggattgcgcaaagtgcgtgcggaaaacgaccgccatcacgccttggacgccgtcgtcgttgcctgctcgaccgttgccatgcagcagaaaattacccgttttgtacgctataaagagatgaacgcgtttgacggtaaaaccatagacaaagaaacaggagaagtgctgcatcaaaaaacacacttcccacaaccttgggaatttttcgcacaagaagtcatgattcgcgtcttcggcaaaccggacggcaaacccgaattcgaagaagccgataccctagaaaaactgcgcacgttgcttgccgaaaaattatcatctcgccccgaagccgtacacgaatacgttacgccactgtttgtttcacgcgcgcccaatcggaagatgagcgggcaagggcatatggagaccgtcaaatccgccaaacgactggacgaaggcgtcagcgtgttgcgcgtaccgctgacacagttaaaactgaaagacttggaaaaaatggtcaatcgggagcgcgaacctaagctatacgaagcactgaaagcacggctggaagcacataaagacgatcctgccaaagcctttgccgagccgttttacaaatacgataaagcaggcaaccgcacccaacaggtaaaagccgtacgcgtagagcaagtacagaaaaccggcgtatgggtgcgcaaccataacggtattgccgacaacgcaaccatggtgcgcgtagatgtgtttgagaaaggcgacaagtattatctggtaccgatttacagttggcaggtagcgaaagggattttgccggatagggctgttgtacaaggaaaagatgaagaagattggcaacttattgatgatagtttcaactttaaattctcattacaccctaatgatttagtcgaggttataacaaaaaaagctagaatgtttggttactttgccagctgccatcgaggcacaggtaatatcaatatacgcattcatgatcttgatcataaaattggcaaaaatggaatactggaaggtatcggcgtcaaaaccgccctttcattccaaaaataccaaattgacgaactgggcaaagaaatcagaccatgccgtctgaaaaaacgcccgcctgtccgttaa

SEQ ID NO: 25 - DNA, 4188 bp, Treponema denticola
atgaaaaaggaaattaaggattattttctcggattggatgtaggaaccggatcggttggttgggcagttactgatactgactataaactcttaaaggctaatcgtaaagacctttggggaatgaggtgttttgagacggcggaaactgcggaagtgagaaggcttcacaggggggctaggcgccgtattgagagaagaaaaaaaagaataaagctgcttcaagagcttttttcccaagaaattgcaaaaacagatgagggatttttccaaagaatgaaggaaagccctttctatgcagaagacaagactatattacaggaaaacactctttttaatgataaagattttgccgataagacctaccataaagcctatcctaccataaaccatctgataaaggcttggattgaaaacaaggtaaagccggatccaaggttattatacttagcctgtcataatattataaaaaaaagaggtcattttttattcgagggcgatttcgattcagaaaatcagtttgatacttctatacaagccctttttgaatatctgcgtgaagatatggaagtcgatattgatgccgatagccaaaaagtaaaagagattttaaaggatagctctttaaaaaattccgaaaaacaaagccgcctaaataagattttaggactgaaaccctccgacaaacaaaaaaaagctattactaatttaatatcaggcaacaaaataaactttgccgatctttatgataatccggatttaaaggatgcggagaaaaatagtatatctttttcgaaagatgattttgatgctttgagtgatgatcttgcttccattctaggagattcttttgagcttttattaaaagcaaaggctgtatataactgctcggttctttccaaggtaataggcgatgaacagtatctttcttttgcaaaggtaaaaatatatgaaaagcataaaaccgatttgactaaattaaaaaatgttataaaaaagcatttcccaaaagattataaaaaagtattcggatacaataaaaacgaaaaaaataacaacaattactccggatatgtaggcgtatgtaaaaccaagagtaaaaaactaattataaacaattctgtaaatcaagaagatttttacaaatttttaaaaactatcctttcagcaaaatccgagataaaggaagtaaatgatatattgaccgaaattgaaacagggacttttttacctaaacagatatctaaaagcaatgcggagattccttatcaattacgcaagatggagctggaaaaaatattatcaaacgcagaaaaacatttttcctttttaaaacaaaaagatgaaaaaggtttatctcacagtgaaaagattataatgcttttaacatttaagattccttattatattggacctataaacgataaccataaaaaattttttcccgatagatgctgggtagtaaaaaaagaaaaatcgccttccggtaaaactactccatggaacttttttgatcatatcgataaagaaaaaacagctgaagcatttattacaagcagaaccaatttttgcacatatttagtaggggaatccgttttaccaaaaagttctcttttatattccgagtataccgttttaaatgaaatcaacaatttacagattatcattgacggaaaaaatatctgcgatattaaactaaaacaaaaaatatacgaagatttatttaaaaaatataaaaagattacacaaaaacaaatttcaacttttatcaaacacgaaggtatttgcaataaaactgatgaagtaattattctaggtatcgataaagaatgtacatcttcgttaaaatcatatatagaacttaaaaacatattcggaaagcaagtagatgaaatttctacaaagaatatgcttgaagaaattatacgatgggctactatctatgatgaaggagaaggcaaaacaatacttaaaacaaaaataaaagccgaatatggaaaatattgttctgatgaacagatcaaaaaaattctaaatcttaaattttcaggttggggccgcttgtcacgcaaattccttgaaaccgtcacatcagaaatgccgggttttagcgaaccggtaaatataataactgcaatgcgggaaactcaaaataatttaatggagttgcttagcagtgaatttacatttactgaaaatattaaaaagataaattcgggatttgaagatgctgaaaagcaattttcatatgacggtttggttaagcctctgtttttatcaccatcggtaaaaaaaatgttgtggcagactctaaagcttgtaaaagaaatatcgcatattacccaagcccctcctaaaaaaatatttatagaaatggcaaagggtgcagagcttgaacctgcgaggactaagacaagattaaaaattttacaagacttatacaataactgtaaaaatgatgcggatgcttttagttccgagataaaagacctttcaggtaaaatagaaaatgaagataatttaaggcttcgaagcgacaaactttatctttattacacgcagcttggaaagtgcatgtattgcggtaaaccgattgaaataggccatgtatttgatacaagcaactatgatatagatcatatttatccccaatccaagattaaagatgacagtataagtaatcgggttttagtatgcagcagctgcaataaaaataaggaagataaatatcctttgaagtctgaaattcaatcaaagcaaaggggcttttggaattttttacaacgaaataactttataagccttgaaaaattgaataggttaacaagggccactccaatctcggatgacgaaacggcaaaattcattgccagacagcttgtagaaacaagacaggcgacaaaagtagctgcaaaagtattagaaaaaatgtttcccgaaactaagattgtttattctaaagctgaaaccgtatcaatgtttagaaataaattcgatattgtaaaatgcagagaaataaacgattttcatcatgctcatgatgcatatttaaatattgttgtcggaaatgtatataatacaaaatttacaaataatccttggaactttataaaggagaaacgggataatccaaagattgccgatacttacaattattataaagtttttgattatgatgtaaaaagaaataatattacggcatgggaaaaaggaaaaacaattatcactgtgaaggatatgcttaaaagaaatacccctatttatacacgccaagccgcctgcaaaaaaggagaactctttaaccaaaccattatgaaaaaaggattgggccagcatcctctaaaaaaagaaggtcctttttctaatatttcaaaatatgggggctataataaagtctctgctgcatattatactcttatagaatacgaagaaaaagggaataaaatacgaagcttagaaaccatccctctatatttggtaaaagacattcaaaaagatcaagatgtattaaagagttacttaacagatctgctagggaaaaaagaatttaagattttggttcctaaaataaaaatcaactccctcttaaaaattaacggtttcccttgtcatataacagggaaaaccaatgattctttcttactgcgtccggctgttcagttttgctgttcaaataatgaagttctttattttaaaaaaattataagattcagtgaaataagaagtcaaagagaaaagataggaaaaacaatttctccttatgaagacttatcctttagatcttatatcaaagaaaatttatggaaaaagacaaaaaatgatgaaataggagaaaaggagttttatgaccttcttcaaaagaagaatttggaaatctatgatatgcttttaacaaaacataaggatactatttataaaaaaagacctaactctgcaactattgatatcttagtcaaaggaaaagaaaagtttaaatctttaataatcgaaaatcagtttgaagttattttagagattttaaaactgttttctgccactagaaatgtatcagacttacaacatataggcggaagcaaatattcaggagttgcaaagataggaaataaaatatctagtcttgataactgtattttaatttaccaatcaataacaggtatttttgaaaaaaggattgatttgttaaaggtatga

SEQ ID NO: 26 - DNA, 4188 bp, Treponema denticola
atgaagaaggagatcaaggactacttcctgggcctggacgtgggcaccggcagcgtgggctgggccgtgaccgacaccgactacaagctgctgaaggccaaccgcaaggacctgtggggcatgcgctgcttcgagactgctgagaccgccgaggtgcgccggctgcaccgcggtgctcgccggcgcatcgagcgccgcaagaagcgcatcaagctgctgcaggagctgttcagccaggagatcgccaagaccgacgagggcttcttccagcgcatgaaggagagccccttctacgccgaggacaagaccatcctgcaggagaacaccctgttcaacgacaaggacttcgccgacaagacctaccacaaggcctaccccaccatcaaccacctgatcaaggcctggatcgagaacaaggtgaagcccgaccctcgcctgctgtacctggcctgccacaacatcatcaagaagcgcggccacttcctgttcgagggcgacttcgacagcgagaaccagttcgacaccagcatccaggccctgttcgagtacctgcgcgaggacatggaggtggacatcgacgccgacagccagaaggtgaaggagatcctgaaggacagcagcctgaagaacagcgagaagcagagccgcctgaacaagatcctgggcctgaagcccagcgacaagcagaagaaggccatcaccaacctgatcagcggcaacaagatcaacttcgccgacctgtacgacaaccccgacctgaaggacgccgagaagaacagcatcagcttcagcaaggacgacttcgacgccctgagcgacgacctggccagcatcctgggcgacagcttcgagctgctgctgaaggccaaggccgtgtacaactgcagcgtgctgagcaaggtgatcggcgacgagcagtacctgagcttcgccaaggtgaagatctacgagaagcacaagaccgaccttaccaagctgaagaacgtgatcaagaagcacttccccaaggactacaagaaggtgttcggctacaacaagaacgagaagaacaacaacaactacagcggctacgtgggcgtgtgcaagaccaagagcaagaagctgatcatcaacaacagcgtgaaccaggaggacttctacaagttcctgaagaccatcctgagcgccaagagcgagatcaaggaggtgaacgacatcctgaccgagatcgagaccggcaccttcctgcccaagcagatcagcaagagcaacgccgagatcccctaccagctgcgcaagatggagctggagaagatcctgagcaacgccgagaagcacttcagcttcctgaagcagaaggacgagaagggcctgagccacagcgagaagatcatcatgctgctgaccttcaagatcccctactacatcggccccatcaacgacaaccacaagaagttcttccccgaccgctgctgggtggtgaagaaggagaagagccccagcggcaagaccaccccctggaacttcttcgaccacatcgacaaggagaagaccgccgaggccttcatcaccagccgcaccaacttctgcacatacctggtgggcgagagcgtgctgcccaagagcagcctgctgtacagcgagtacaccgtgctgaacgagatcaacaacctgcagatcatcatcgacggcaagaacatctgcgacatcaagctgaagcagaagatctacgaggacctgttcaagaagtacaagaagatcacccagaagcagatcagcaccttcatcaagcacgagggcatctgcaacaagaccgacgaggtgatcatcctgggcatcgacaaggagtgcaccagcagcctgaagagctacatcgagctgaagaacatcttcggcaagcaggtggacgagatcagcaccaagaacatgctggaggagatcatccgctgggccaccatctacgacgagggcgagggcaagaccatcctgaagaccaagatcaaggccgagtacggcaagtactgcagcgacgagcagatcaagaagatcctgaacctgaagttcagcggctggggccgcctgagccgcaagttcctggagaccgtgaccagcgagatgcccggcttcagcgagcccgtgaacatcatcaccgccatgcgcgagacccagaacaacctgatggagctgctgagcagcgagttcaccttcaccgagaacatcaagaagatcaacagcggcttcgaggacgccgagaagcagttcagctacgacggcctggtgaagcccctgttcctgagccccagcgtgaagaagatgctgtggcagaccctgaagctggtgaaggagatcagccacatcacccaggctcctcctaagaagatcttcatcgagatggccaagggcgccgagctggagcctgctcgcaccaagacccgcctgaagatcctgcaggacctgtacaacaactgcaagaacgacgccgacgcattcagcagcgagatcaaggacctgagcggcaagatcgagaacgaggacaacctgcgcctgcgcagcgacaagctgtacctgtactacacccagctgggcaagtgcatgtactgcggcaagcccatcgagatcggccacgtgttcgacaccagcaactacgacatcgaccacatctacccccagagcaagatcaaggacgacagcatcagcaaccgcgtgctggtgtgcagcagctgcaacaagaacaaggaggacaagtaccctctgaagagcgagatccagagcaagcagcgcggcttctggaacttcctgcagcgcaacaacttcatcagcctggagaagctgaaccgcctgacccgcgccacccccatcagcgacgacgagaccgccaagttcatcgcccgccagctggtggagactcgccaagctaccaaggtggccgccaaggtgctggagaagatgttccccgagaccaagatcgtgtacagcaaggccgagaccgtgagcatgttccgcaacaagttcgacatcgtgaagtgccgcgagatcaacgacttccaccacgcccacgacgcctacctgaacatcgtggtgggcaacgtgtacaacaccaagttcaccaacaacccctggaatttcattaaggagaagcgcgacaaccccaagatcgccgacacctacaactactacaaggtgttcgactacgacgtgaagcgcaacaacatcaccgcctgggagaagggcaagaccatcatcaccgtgaaggacatgctgaagcgcaacacccccatctacacccgccaggccgcctgcaagaagggcgagctgttcaaccagaccatcatgaagaagggcctgggccagcaccccctgaagaaggagggccccttcagcaacatcagcaagtacggcggctacaacaaggtgagcgccgcctactacaccctgatcgagtacgaggagaagggcaacaagatccgcagcctggagaccatccccctgtacctggtgaaggacatccagaaggaccaggacgtgctgaagagctacctgaccgacctgctgggcaagaaggagttcaagatcctggtgcccaagatcaagatcaacagcctgctgaagatcaacggcttcccctgccacatcaccggcaagaccaacgacagcttcctgctgcgccccgccgtgcagttctgctgcagcaacaacgaggtgctgtacttcaagaagatcatccgcttcagcgagatccgcagccagcgcgagaagatcggcaagaccatcagcccctacgaggacctgagcttccgcagctacatcaaggagaacctgtggaagaagaccaagaacgacgagatcggcgagaaggagttctacgacctgctgcagaagaagaacctggagatctacgacatgctgctgaccaagcacaaggacaccatctacaagaagcgccccaacagcgccaccatcgacatcctggtgaagggcaaggagaagttcaagagcctgatcatcgagaaccagttcgaggtgatcctggagatcctgaagctgttcagcgccacccgcaacgtgagcgacctgcagcacatcggcggcagcaagtacagcggcgtggccaagatcggcaacaagatcagcagcctggacaactgcatcctgatctaccagagcatcaccggcatcttcgagaagcgcatcgacctgctgaaggtgtaa

SEQ ID NO: 27 - DNA, 4188 bp, Treponema denticola
atgaagaaggagatcaaggactacttcctgggcctggccgtgggcaccggcagcgtgggctgggccgtgaccgacaccgactacaagctgctgaaggccaaccgcaaggacctgtggggcatgcgctgcttcgagactgctgagaccgccgaggtgcgccggctgcaccgcggtgctcgccggcgcatcgagcgccgcaagaagcgcatcaagctgctgcaggagctgttcagccaggagatcgccaagaccgacgagggcttcttccagcgcatgaaggagagccccttctacgccgaggacaagaccatcctgcaggagaacaccctgttcaacgacaaggacttcgccgacaagacctaccacaaggcctaccccaccatcaaccacctgatcaaggcctggatcgagaacaaggtgaagcccgaccctcgcctgctgtacctggcctgccacaacatcatcaagaagcgcggccacttcctgttcgagggcgacttcgacagcgagaaccagttcgacaccagcatccaggccctgttcgagtacctgcgcgaggacatggaggtggacatcgacgccgacagccagaaggtgaaggagatcctgaaggacagcagcctgaagaacagcgagaagcagagccgcctgaacaagatcctgggcctgaagcccagcgacaagcagaagaaggccatcaccaacctgatcagcggcaacaagatcaacttcgccgacctgtacgacaaccccgacctgaaggacgccgagaagaacagcatcagcttcagcaaggacgacttcgacgccctgagcgacgacctggccagcatcctgggcgacagcttcgagctgctgctgaaggccaaggccgtgtacaactgcagcgtgctgagcaaggtgatcggcgacgagcagtacctgagcttcgccaaggtgaagatctacgagaagcacaagaccgaccttaccaagctgaagaacgtgatcaagaagcacttccccaaggactacaagaaggtgttcggctacaacaagaacgagaagaacaacaacaactacagcggctacgtgggcgtgtgcaagaccaagagcaagaagctgatcatcaacaacagcgtgaaccaggaggacttctacaagttcctgaagaccatcctgagcgccaagagcgagatcaaggaggtgaacgacatcctgaccgagatcgagaccggcaccttcctgcccaagcagatcagcaagagcaacgccgagatcccctaccagctgcgcaagatggagctggagaagatcctgagcaacgccgagaagcacttcagcttcctgaagcagaaggacgagaagggcctgagccacagcgagaagatcatcatgctgctgaccttcaagatcccctactacatcggccccatcaacgacaaccacaagaagttcttccccgaccgctgctgggtggtgaagaaggagaagagccccagcggcaagaccaccccctggaacttcttcgaccacatcgacaaggagaagaccgccgaggccttcatcaccagccgcaccaacttctgcacatacctggtgggcgagagcgtgctgcccaagagcagcctgctgtacagcgagtacaccgtgctgaacgagatcaacaacctgcagatcatcatcgacggcaagaacatctgcgacatcaagctgaagcagaagatctacgaggacctgttcaagaagtacaagaagatcacccagaagcagatcagcaccttcatcaagcacgagggcatctgcaacaagaccgacgaggtgatcatcctgggcatcgacaaggagtgcaccagcagcctgaagagctacatcgagctgaagaacatcttcggcaagcaggtggacgagatcagcaccaagaacatgctggaggagatcatccgctgggccaccatctacgacgagggcgagggcaagaccatcctgaagaccaagatcaaggccgagtacggcaagtactgcagcgacgagcagatcaagaagatcctgaacctgaagttcagcggctggggccgcctgagccgcaagttcctggagaccgtgaccagcgagatgcccggcttcagcgagcccgtgaacatcatcaccgccatgcgcgagacccagaacaacctgatggagctgctgagcagcgagttcaccttcaccgagaacatcaagaagatcaacagcggcttcgaggacgccgagaagcagttcagctacgacggcctggtgaagcccctgttcctgagccccagcgtgaagaagatgctgtggcagaccctgaagctggtgaaggagatcagccacatcacccaggctcctcctaagaagatcttcatcgagatggccaagggcgccgagctggagcctgctcgcaccaagacccgcctgaagatcctgcaggacctgtacaacaactgcaagaacgacgccgacgcattcagcagcgagatcaaggacctgagcggcaagatcgagaacgaggacaacctgcgcctgcgcagcgacaagctgtacctgtactacacccagctgggcaagtgcatgtactgcggcaagcccatcgagatcggccacgtgttcgacaccagcaactacgacatcgctgctatctacccccagagcaagatcaaggacgacagcatcagcaaccgcgtgctggtgtgcagcagctgcgccaagaacaaggaggacaagtaccctctgaagagcgagatccagagcaagcagcgcggcttctggaacttcctgcagcgcaacaacttcatcagcctggagaagctgaaccgcctgacccgcgccacccccatcagcgacgacgagaccgccaagttcatcgcccgccagctggtggagactcgccaagctaccaaggtggccgccaaggtgctggagaagatgttccccgagaccaagatcgtgtacagcaaggccgagaccgtgagcatgttccgcaacaagttcgacatcgtgaagtgccgcgagatcaacgacttccaccacgcccacgacgcctacctgaacatcgtggtgggcaacgtgtacaacaccaagttcaccaacaacccctggaatttcattaaggagaagcgcgacaaccccaagatcgccgacacctacaactactacaaggtgttcgactacgacgtgaagcgcaacaacatcaccgcctgggagaagggcaagaccatcatcaccgtgaaggacatgctgaagcgcaacacccccatctacacccgccaggccgcctgcaagaagggcgagctgttcaaccagaccatcatgaagaagggcctgggccagcaccccctgaagaaggagggccccttcagcaacatcagcaagtacggcggctacaacaaggtgagcgccgcctactacaccctgatcgagtacgaggagaagggcaacaagatccgcagcctggagaccatccccctgtacctggtgaaggacatccagaaggaccaggacgtgctgaagagctacctgaccgacctgctgggcaagaaggagttcaagatcctggtgcccaagatcaagatcaacagcctgctgaagatcaacggcttcccctgccacatcaccggcaagaccaacgacagcttcctgctgcgccccgccgtgcagttctgctgcagcaacaacgaggtgctgtacttcaagaagatcatccgcttcagcgagatccgcagccagcgcgagaagatcggcaagaccatcagcccctacgaggacctgagcttccgcagctacatcaaggagaacctgtggaagaagaccaagaacgacgagatcggcgagaaggagttctacgacctgctgcagaagaagaacctggagatctacgacatgctgctgaccaagcacaaggacaccatctacaagaagcgccccaacagcgccaccatcgacatcctggtgaagggcaaggagaagttcaagagcctgatcatcgagaaccagttcgaggtgatcctggagatcctgaagctgttcagcgccacccgcaacgtgagcgacctgcagcacatcggcggcagcaagtacagcggcgtggccaagatcggcaacaagatcagcagcctggacaactgcatcctgatctaccagagcatcaccggcatcttcgagaagcgcatcgacctgctgaaggtgtaa

SEQ ID NO: 28 - protein, 1053 aa, Streptococcus aureas
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 29 - DNA, 3162 bp, Streptococcus aureas
atgaaaaggaattatatcttaggattagatatcggaattacatcagtgggttatggaattattgattatgaaactagagatgtcatagatgcgggcgtacgtttatttaaagaggctaatgttgaaaataatgaaggacgacgatcaaaaagaggtgccagaaggcttaagaggcgtcgtagacatagaatacaaagagtaaagaaacttttatttgattacaatttgttgacagatcatagtgagctaagtggaatcaatccttacgaggcgcgcgtaaagggattaagtcaaaaattaagtgaagaggaattttctgcggcattgctacatttagcaaagcgtagaggtgtacataatgttaatgaagtggaagaagatacaggtaatgaattatccactaaagaacaaatttcaagaaatagtaaagcgttagaagagaagtatgttgcagaattacagttggaacgtttgaaaaaagacggtgaagtgagaggttcgattaaccgtttcaaaacatctgactatgtaaaagaagcaaagcagttattaaaagtacaaaaagcatatcatcaacttgatcaatcatttatagacacttatattgatttattggaaacaagaagaacatattatgagggaccaggtgaaggtagcccatttggatggaaagatattaaagaatggtatgaaatgttaatgggacattgtacgtatttcccagaagaattacgtagtgtgaaatatgcctataatgctgatttatataatgcgctgaatgatttgaacaacttggttattacacgagatgagaatgagaagctagagtattatgaaaaattccaaattatcgagaatgtctttaaacaaaagaaaaagccgacgcttaaacaaattgcgaaggaaatcttggtgaatgaagaagacatcaaaggctatcgtgtcacaagtacaggtaaaccagaatttacaaacttgaaagtttatcacgatatcaaagatattacagcaagaaaagaaattatcgagaatgcagagctactcgatcaaatagctaaaatattaactatttaccagtcatcagaagatatacaagaagaattaacaaacctaaattcagaattgacacaagaagagattgaacaaatttcaaacttgaaaggttatacaggaactcataacctttcactaaaggcaataaatttaatattagacgaattgtggcatacgaacgataatcaaatagctattttcaatcgtttgaaacttgtacctaaaaaggtagatttaagccaacaaaaagaaattcctactactttagttgatgattttatactgtctccagtagtgaaacgttcatttatacaatctattaaagttattaacgctattattaaaaaatacggtttgccaaatgatattattattgaacttgcgagagaaaagaattctaaagatgcacaaaaaatgattaatgaaatgcagaagagaaatcgtcaaacgaatgaacgtattgaggaaattataagaacgacaggtaaagaaaatgctaaatatttaattgaaaaaattaagctgcacgatatgcaagaagggaaatgtttatactcgttagaagcaatccctctagaagatttacttaataatccattcaattacgaagtagaccatatcattccacgttctgtttctttcgataactctttcaataataaagtgttggtgaaacaagaagaaaatagtaaaaaaggtaatagaacgccatttcaatatttaagttcttcagattctaaaataagttatgagacattcaaaaagcatattttaaatcttgctaaaggcaaaggtagaatctctaagacgaaaaaagaatatttgttagaagaacgagatatcaatcgcttcagtgtccaaaaagattttattaaccgtaacttagtagatacacgctatgcgacaagagggttaatgaacttattaagatcttattttagagtgaataacttagatgtcaaagtgaaatcgattaatggcggattcacaagtttcttaagaaggaaatggaagttcaaaaaagaaagaaataagggctacaaacaccatgctgaagatgcactgattattgcgaacgctgattttattttcaaagaatggaaaaaactagataaagctaaaaaagtgatggaaaatcaaatgtttgaagaaaagcaagctgaaagtatgcctgaaattgagactgagcaagagtataaagaaatttttataacgcctcatcaaattaaacatattaaggattttaaagattataaatattcacatagagttgataaaaagccgaatagagagttaataaatgatacattatattctacgagaaaagatgacaagggtaatacattaatcgttaataacttaaatggtttatacgataaagataatgataaattgaaaaaattaattaataaatcacctgaaaaattattgatgtatcatcatgatccacaaacatatcaaaaattaaaattgatcatggaacaatatggcgatgagaaaaatccgctttataaatattatgaagaaacaggcaattacttaacaaaatatagtaaaaaagataacggaccagtcatcaaaaaaattaaatattatggtaacaagctaaatgcgcatttagatattacggatgattatccaaatagcagaaataaagtagtaaaactttcattaaaaccatatcgctttgatgtttatttagataatggggtatataaatttgtgacagttaaaaatttagatgttatcaaaaaagaaaactactatgaagttaattcaaagtgttatgaagaagcaaaaaaactgaagaaaattagtaatcaagcagaatttatcgcaagtttttacaataatgacttgattaagattaacggagaattatatagagtcataggtgtaaataatgatctacttaacagaattgaagtaaatatgatagacatcacatatagagaatatttagagaacatgaatgataaaagaccacctagaataattaaaacaatagcaagcaaaacacaatctattaaaaagtattctacagatattctaggcaatctttatgaagtgaagagtaaaaagcatcctcaaatcataaagaaaggatga

SEQ ID NO: 30 - protein, 1629 aa, Francisella tularensis
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRADGTKPFIPAFDISKNEIVEAIIDSFTSKNIFWLPKNIELQKVDNKNIFAIDTSKWFEVETPSDLRDIGIATIQYKIDNNSRPKVRVKLDYVIDDDSKINYFMNHSLLKSRYPDKVLEILKQSTIIEFESSGFNKTIKEMLGMKLAGIYNETSNN

SEQ ID NO: 31 - DNA, 4890 bp, Francisella tularensis
atgaatttcaaaatattgccaatagcaatagatttaggtgttaaaaatactggtgtctttagcgcattttatcaaaaaggaacttctcttgagagattggataataaaaatggcaaagtatatgaactatcaaaagattcttatactttattgatgaataatagaacagcaagaagacatcaaagaagagggatagatagaaagcagctagtcaaaaggctctttaagcttatttggacagagcagctaaatttagagtgggataaagacactcaacaagcaattagctttttatttaatcgtagaggttttagttttattactgatggttattcgcctgaatatttaaatattgttccagagcaagtaaaagcgatacttatggatatatttgatgattacaacggtgaagatgatttagacagttatttaaaattagctactgagcaagaaagcaaaatttctgaaatttataacaagctaatgcaaaaaatattagagtttaaattaatgaaattatgtactgatattaaggatgataaagtaagtactaaaacgcttaaagaaatcacaagctatgaatttgagttattagctgattatttagcaaactatagcgagagtttaaaaacacaaaaatttagttatacagataaacaaggtaatttaaaagagctaagctactatcatcatgataaatataatattcaagaatttctaaagcgacatgctactataaatgatcgaattttagatactcttttaactgatgatttagatatttggaattttaattttgagaaatttgattttgataagaatgaagaaaagcttcagaatcaggaagataaagatcatatacaagcgcatttacatcattttgtttttgcagtaaataaaataaaaagtgaaatggcaagtggtggtcgtcatcgtagccaatattttcaagagataacaaatgtgctagatgaaaataatcatcaagagggatatctcaagaatttctgtgaaaatttgcataataaaaaatattcaaatttaagtgttaaaaatttagttaatctaattggtaacctaagtaatttagagctaaaaccgctaagaaaatattttaatgacaaaattcacgcaaaagctgatcattgggatgagcaaaagtttacagaaacttattgccactggatattaggagagtggcgagtaggtgtcaaagatcaagataagaaagatggcgctaaatatagttataaagatctgtgtaatgaattaaaacaaaaagttactaaggctggtttggtagattttttattagagttagatccatgtagaactataccaccatatctggataacaataaccgtaaaccaccaaaatgtcaaagtttgattttaaatccgaagtttttagataatcaatatccaaactggcaacaatatttacaagaattaaagaaactacaaagtattcaaaattatttagacagttttgaaactgatttaaaagtcttaaagtcaagtaaagatcaaccatattttgttgaatacaagagttcaaatcagcaaatagcaagtggtcaaagagattataaagatttagatgctcgaatattacagtttatatttgatagggtaaaagctagtgatgagttgcttttgaatgagatttattttcaggctaaaaaacttaaacaaaaagctagctctgagttagaaaaactcgagtcgagcaaaaagctagatgaagttatagcaaatagtcaactatcacagatactaaagtctcaacatacaaatggtatttttgaacagggtacttttttgcatttggtttgtaaatattataaacaaagacaaagagcgagagactctaggctatatattatgcctgaatatcgttatgataaaaaactacataaatataacaatacaggcaggtttgatgatgataatcagctgctaacatattgtaatcataagccaagacaaaaaagataccaattgttaaatgatttagctggggtgttgcaggtatcacctaattttttgaaagataaaattggttctgatgatgatctatttattagcaaatggttggtagagcatattagaggatttaaaaaagcttgtgaagatagtttaaaaatacaaaaagacaatagaggattattaaatcataaaataaatatagctaggaatacaaaaggcaaatgtgaaaaagaaatatttaatttaatatgtaaaatagaaggttcagaagataaaaaaggtaattacaagcatggtttagcttacgaattaggagtacttttatttggtgaacctaatgaagctagtaaacctgagttcgatagaaaaattaaaaaatttaactcaatatacagttttgcacagattcaacaaattgcttttgcagagcgtaaaggcaatgctaacacttgtgcagtttgtagtgctgataatgctcatagaatgcaacaaattaagatcactgagcctgtagaggacaataaagataagataatcttaagtgccaaagctcagagactaccagcgattccaactagaatagttgacggtgcggttaagaaaatggcaactatattagctaaaaatatagttgatgataattggcagaatatcaaacaagttttatcagcaaaacatcagttacatatacctattatcacagaatcaaatgcttttgagtttgaaccagcattagctgatgtaaaaggtaagagcctaaaagataggagaaaaaaagcattagagagaataagtcctgaaaatatattcaaggataaaaacaatagaataaaagaatttgctaaaggtatatcagcatatagtggtgctaatttaactgatggcgattttgatggtgcaaaagaagaattagatcatataatacctcgttcacataaaaaatacggtactctaaatgatgaagcaaatctaatttgtgtaactcgtggtgataataaaaataaaggtaatagaattttctgcctacgtgatcttgcagataactataaactaaaacagtttgagacaactgatgatttagaaattgaaaagaagatagctgatacaatctgggatgctaacaagaaagattttaaatttggtaattatcgtagttttattaacctaacaccacaagagcagaaagcatttcgtcacgcgctatttctggctgatgaaaatcctatcaaacaagcagtcataagagcgataaataatcgtaatcgtacatttgtaaatggcactcaacgctattttgcagaagtactggcaaacaatatctatctaagggctaaaaaagaaaatctaaatacagataaaatttcatttgattattttggtattccaactataggtaatggtagaggtattgctgaaatccgtcaactttatgaaaaagttgatagtgatatacaagcttatgcaaaaggtgataaacctcaagctagctactctcacctaatagatgcgatgctggctttttgtattgctgctgatgaacacagaaatgatggaagtataggtctagaaatcgataaaaattatagtttatatccattagataaaaatacaggagaagtctttaccaaagatatttttagtcaaattaaaattactgataatgagtttagcgataaaaaattagtaagaaaaaaagctatagagggctttaacacgcatagacaaatgactagagatggcatttatgcagaaaattacctaccaatactaatccataaagaactaaatgaagttagaaaaggctatacttggaaaaatagtgaagaaataaaaatattcaaaggtaaaaagtacgatatacaacaattgaataaccttgtgtattgtctaaaatttgtagataaacctatatctatagatatacaaattagtaccttagaagagttaagaaatatattaacaacaaataatatagctgctacagcagaatactattatataaatctaaaaacccaaaaattacatgagtattatatcgaaaactataatactgccttaggttataaaaaatacagtaaagaaatggagtttttgagaagcttagcttatcgtagcgaaagggtaaaaattaaatcaatagatgatgtaaagcaggttttggataaggatagtaactttatcatcggtaagattactttaccatttaaaaaagagtggcaaagactatatcgtgagtggcaaaatacaactatcaaagatgattatgagtttttaaaatcattctttaatgttaaaagtattactaagttgcataaaaaagttagaaaagatttctctttacctatttctacaaatgaaggtaaattcctggtcaaaagaaaaacatgggataacaattttatctatcagatattaaatgattctgattctagagcagacggaacaaagccatttattccagcttttgacatttctaaaaatgaaatagtcgaagccataattgattcatttacatcaaaaaatattttttggctgcctaaaaatatagaattacaaaaggtggataataaaaacatttttgctatagatactagtaaatggttcgaagtagaaacacctagtgatcttagagacattggaatagcaacaattcaatacaagatagataataattctcgccctaaagtcagagttaaacttgattatgttatcgatgatgatagtaagataaattattttatgaatcattctttattaaaatcaagatatcctgacaaagttttagaaattttaaaacaatcaactattatagaatttgaaagttcaggttttaataaaactatcaaagaaatgcttggtatgaaattagcaggtatttataatgaaacatctaataattag

SEQ ID NO: 32 - DNA, 3903 bp, Francisella tularensis
  Francisella tularensis subsp. novicida (strain U112)
atgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataactaa

SEQ ID NO: 33 - protein, 1300 aa, Francisella tularensis
  Francisella tularensis subsp. novicida (strain U112)
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 34 - DNA, 3924 bp, Acidaminococcus sp.
  Acidaminococcus sp. (strain BV3L6)
atgacccaatttgaaggttttaccaatttataccaagtttcgaagacccttcgttttgaactgattccccaaggaaaaacactcaaacatatccaggagcaagggttcattgaggaggataaagctcgcaatgaccattacaaagagttaaaaccaatcattgaccgcatctataagacttatgctgatcaatgtctccaactggtacagcttgactgggagaatctatctgcagccatagactcctatcgtaaggaaaaaaccgaagaaacacgaaatgcgctgattgaggagcaagcaacatatagaaatgcgattcatgactactttataggtcggacggataatctgacagatgccataaataagcgccatgctgaaatctataaaggactttttaaagctgaacttttcaatggaaaagttttaaagcaattagggaccgtaaccacgacagaacatgaaaatgctctactccgttcgtttgacaaatttacgacctatttttccggcttttatgaaaaccgaaaaaatgtctttagcgctgaagatatcagcacggcaattccccatcgaatcgtccaggacaatttccctaaatttaaggaaaactgccatatttttacaagattgataaccgcagttccttctttgcgggagcattttgaaaatgtcaaaaaggccattggaatctttgttagtacgtctattgaagaagtcttttcctttcccttttataatcaacttctaacccaaacgcaaattgatctttataatcaacttctcggcggcatatctagggaagcaggcacagaaaaaatcaagggacttaatgaagttctcaatctggctatccaaaaaaatgatgaaacagcccatataatcgcgtccctgccgcatcgttttattcctctttttaaacaaattctttccgatcgaaatacgttatcctttattttggaagaattcaaaagcgatgaggaagtcatccaatccttctgcaaatataaaaccctcttgagaaacgaaaatgtactggagactgcagaagcccttttcaatgaattaaattccattgatttgactcatatctttatttcccataaaaagttagaaaccatctcttcagcgctttgtgaccattgggataccttgcgcaatgcactttacgaaagacggatttctgaactcactggcaaaataacaaaaagtgccaaagaaaaagttcaaaggtcattaaaacatgaggatataaatctccaagaaattatttctgctgcaggaaaagaactatcagaagcattcaaacaaaaaacaagtgaaattctttcccatgcccatgctgcacttgaccagcctcttcccacaacattaaaaaaacaggaagaaaaagaaatcctcaaatcacagctcgattcgcttttaggcctttatcatcttcttgattggtttgctgtcgatgaaagcaatgaagtcgacccagaattctcagcacggctgacaggcattaaactagaaatggaaccaagcctttcgttttataataaagcaagaaattatgcgacaaaaaagccctattcggtggaaaaatttaaattgaattttcaaatgccaacccttgcctctggttgggatgtcaataaagaaaaaaataatggagctattttattcgtaaaaaatggtctctattaccttggtatcatgcctaaacagaaggggcgctataaagccctgtcttttgagccgacagaaaaaacatcagaaggattcgataagatgtactatgactacttcccagatgccgcaaaaatgattcctaagtgttccactcagctaaaggctgtaaccgctcattttcaaactcataccacccccattcttctctcaaataatttcattgaacctcttgaaatcacaaaagaaatttatgacctgaacaatcctgaaaaggagcctaaaaagtttcaaacggcttatgcaaagaagacaggcgatcaaaaaggctatagagaagcgctttgcaaatggattgactttacgcgggattttctctctaaatatacgaaaacaacttcaatcgatttatcttcactccgcccttcttcgcaatataaagatttaggggaatattacgccgaactgaatccgcttctctatcatatctccttccaacgaattgctgaaaaggaaatcatggatgctgtagaaacgggaaaattgtatctgttccaaatctacaataaggattttgcgaagggccatcacgggaaaccaaatctccacaccctgtattggacaggtctcttcagtcctgaaaaccttgcgaaaaccagcatcaaacttaatggtcaagcagaattgttctatcgacctaaaagccgcatgaagcggatggcccatcgtcttggggaaaaaatgctgaacaaaaaactaaaggaccagaagacaccgattccagataccctctaccaagaactgtacgattatgtcaaccaccggctaagccatgatctttccgatgaagcaagggccctgcttccaaatgttatcaccaaagaagtctcccatgaaattataaaggatcggcggtttacttccgataaatttttcttccatgttcccattacactgaattatcaagcagccaatagtcccagtaaattcaaccagcgtgtcaatgcctaccttaaggagcatccggaaacgcccatcattggtatcgatcgtggagaacgcaatctaatctatattaccgtcattgacagtactgggaaaattttggagcagcgttccctgaataccatccagcaatttgactaccaaaaaaaattggacaacagggaaaaagagcgtgttgccgcccgtcaagcctggtccgtcgtcggaacgatcaaagaccttaaacaaggctacttgtcacaggtcatccatgaaattgtagacctgatgattcattaccaagctgttgtcgtccttgaaaacctcaacttcggatttaaatcaaaacggacaggcattgccgaaaaagcagtctaccaacaatttgaaaagatgctaatagataaactcaactgtttggttctcaaagattatcctgctgagaaagtgggaggcgtcttaaacccgtatcaacttacagatcagttcacgagctttgcaaaaatgggcacgcaaagcggcttccttttctatgtaccggccccttatacctcaaagattgatcccctgactggttttgtcgatccctttgtatggaagaccattaaaaatcatgaaagtcggaagcatttcctagaaggatttgatttcctgcattatgatgtcaaaacaggtgattttatcctccattttaaaatgaatcggaatctctctttccagagagggcttcctggcttcatgccagcttgggatattgttttcgaaaagaatgaaacccaatttgatgcaaaagggacgcccttcattgcaggaaaacgaattgttcctgtaatcgaaaatcatcgttttacgggtcgttacagagacctctatcccgctaatgaactcattgcccttctggaagaaaaaggcattgtctttagagacggaagtaatatattacccaaacttttagaaaatgatgattctcatgcaattgatacgatggtcgccttgattcgcagtgtactccaaatgagaaacagcaatgccgcaacgggggaagactacatcaactctcccgttagggatctgaacggggtgtgtttcgacagtcgattccaaaatccagaatggccaatggatgcggatgccaacggagcttatcatattgccttaaaagggcagcttcttctgaaccacctcaaagaaagcaaagatctgaaattacaaaacggcatcagcaaccaagattggctggcctacattcaggaactgagaaactga

SEQ ID NO: 35 - protein, 1307 aa, Acidaminococcus sp.
  Acidaminococcus sp. (strain BV3L6)
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 36 - DNA, 3741 bp, Lachnospiraceae bacterium
  Lachnospiraceae bacterium (strain ND2006)
atgcttaagaatgttggaattgataggttagatgttgaaaaagggagaaaaaatatgtctaaattagagaagtttacaaattgttactctttgtcaaaaacacttcgttttaaggcgattcctgttggaaaaacccaagaaaatattgataataaaagattgcttgtcgaggatgaaaaacgtgcagaagattataagggggttaaaaaattacttgataggtattatttatcatttattaatgatgttcttcattccattaaactaaagaatttaaataattatatttcgttgtttagaaagaaaactcggacggaaaaagaaaacaaagaattagaaaatttagagataaatttacgtaaagaaatcgctaaggcttttaagggtaatgaaggttataaatctttatttaagaaggatattatcgagacgatattgcctgaatttcttgatgataaagatgaaattgctttggttaattcatttaatggatttacaacggcatttaccggtttttttgataatagggaaaatatgttttcggaagaagctaaatcaacctcaattgcttttcgttgtattaatgagaatttaacaagatatatatcaaatatggatatatttgaaaaagttgatgcaattttcgataagcatgaagtacaggaaataaaagaaaaaattctaaacagtgattatgatgttgaagatttcttcgaaggagaattttttaattttgttcttacgcaagaaggtatcgatgtttataacgctataattggtggctttgtgacagaatccggagaaaaaataaaaggattaaatgaatatattaatttatataatcagaaaactaagcaaaaattaccgaagtttaagcctttatataaacaggttttatcagatagagagtcactttctttttatggcgaaggttatacatctgatgaggaagttttagaagtatttagaaatactcttaataagaattcagaaatattttcttcaattaagaaattggaaaagttatttaaaaacttcgatgaatattcaagtgcaggaattttcgtaaaaaatggaccggctatttctacaatttctaaggatatatttggagagtggaatgtaattagagacaaatggaatgcggagtacgatgatatacatttaaaaaagaaggctgtagtaacagaaaaatatgaagatgacaggcgtaaatcattcaaaaaaataggaagtttttcattggagcagttgcaagaatacgctgatgctgatctatctgtggtagagaagttaaaagaaatcattatccaaaaagtggatgagatatataaagtttatggctcgtcagaaaaattgttcgatgctgattttgtactagaaaaatcgttaaaaaagaatgatgcagttgtagcaataatgaaagatttactagattctgtgaagtcttttgaaaattatataaaagccttttttggagagggaaaagaaacaaatcgagatgaatcattttatggtgattttgttttggcatatgacattcttttgaaagtggatcatatttatgatgcaatacgaaattatgtgacacaaaaaccgtattcgaaagataagtttaaattatattttcaaaacccgcaatttatggggggctgggataaggataaagagacagactatagggcaactatacttagatatggctcaaagtattacttggcgattatggataaaaaatatgctaagtgcttgcaaaaaatagataaggatgatgtaaatggaaactatgaaaaaataaattataagttgcttccaggacctaataagatgcttccaaaggtgttttttagtaagaagtggatggcttattataatccgtcggaagatattcaaaaaatatataaaaatggaacatttaaaaaaggagatatgtttaatttaaatgattgtcataaattaattgatttctttaaggattcaatcagtcggtatccgaaatggagtaacgcatatgattttaacttttctgagaccgagaaatataaggatatagcaggtttttacagagaggttgaagaacaaggatataaagtatcatttgaaagtgcgtctaaaaaagaagttgataaattggtagaagaaggaaaattatacatgttccaaatttataataaagacttttcggataaaagtcatggaacgccaaatcttcatacaatgtattttaagttgctgtttgatgaaaataatcatggtcaaattaggctttctggtggtgctgagctattcatgcgacgtgcaagtttgaaaaaggaagaattagttgtgcatcctgccaatagcccgatagcgaataaaaacccggataatccaaagaaaacgactacgttgtcatatgatgtatacaaggacaaaagattttcggaagatcagtatgagttgcatatacctattgcaataaataaatgccctaaaaatatatttaagataaatacagaggttagagtgctgctgaagcatgatgataatccttatgttataggaattgataggggggagagaaatttactttacattgtggtggttgatggtaagggtaatattgtggagcaatattcgctgaatgaaataattaataattttaatggaattagaattaagacggattaccattcacttttggataaaaaggagaaggaaagatttgaagctcgtcaaaattggacgtctatagaaaacattaaagaactaaaagccggatatattagtcaggttgttcataagatatgtgagttggtagaaaaatatgatgcggtaattgcacttgaagatttgaattctggttttaagaatagtcgagttaaagttgaaaagcaagtatatcagaaatttgaaaaaatgctgattgataaacttaactatatggtagataagaaatctaatccttgcgctacgggtggtgctctgaaaggctatcaaattactaacaagtttgagagttttaagtcgatgagtacacaaaatggttttattttttatattccggcgtggttgactagcaaaattgatccgtcaacaggatttgtaaatttgttgaaaacaaagtatacgagcattgcagattcaaagaaatttataagttcttttgacagaattatgtatgtacctgaagaagatttattcgagtttgcattagattataagaatttttctcggacagacgcggattatataaaaaaatggaaactctatagctatggtaacaggattagaatatttagaaatcctaaaaaaaataatgtatttgattgggaagaggtatgtcttacatcagcctataaggaactttttaataaatatgggattaattatcagcaaggagatatacgagctctcttatgtgaacagagtgataaggcattctatagctcttttatggcattaatgtcactcatgctgcaaatgagaaatagtataacaggtaggacggatgtagattttttgatttcaccagtaaaaaattctgacggtattttttatgattccagaaattatgaagctcaggaaaatgcaatattaccgaaaaatgcagatgctaatggggcttataatatcgcaagaaaagttttgtgggctataggtcagtttaaaaaggctgaagatgaaaaacttgataaggttaaaattgcaatatcaaataaggaatggctcgaatatgcgcaaacaagtgttaagcattga

SEQ ID NO: 37 - protein, 1228 aa, Lachnospiraceae bacterium
  Lachnospiraceae bacterium (strain ND2006)
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 38 - protein, 1064 aa, Bradyrhizobium sp.
  Bradyrhizobium sp. BTAi1
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 39 - protein, 1035 aa, Candidatus Puniceispirillum marinum
MRRLGLDLGTNSIGWCLLDLGDDGEPVSIFRTGARIFSDGRDPKSLGSLKATRREARLTRRRRDRFIQRQKNLINALVKYGLMPADEIQRQALAYKDPYPIRKKALDEAIDPYEMGRAIFHINQRRGFKSNRKSADNEAGVVKQSIADLEMKLGEAGARTIGEFLADRQATNDTVRARRLSGTNALYEFYPDRYMLEQEFDTLWAKQAAFNPSLYIEAARERLKEIVFFQRKLKPQEVGRCIFLSDEDRISKALPSFQRFRIYQELSNLAWIDHDGVAHRITASLALRDHLFDELEHKKKLTFKAMRAILRKQGVVDYPVGFNLESDNRDHLIGNLTSCIMRDAKKMIGSAWDRLDEEEQDSFILMLQDDQKGDDEVRSILTQQYGLSDDVAEDCLDVRLPDGHGSLSKKAIDRILPVLRDQGLIYYDAVKEAGLGEANLYDPYAALSDKLDYYGKALAGHVMGASGKFEDSDEKRYGTISNPTVHIALNQVRAVVNELIRLHGKPDEVVIEIGRDLPMGADGKRELERFQKEGRAKNERARDELKKLGHIDSRESRQKFQLWEQLAKEPVDRCCPFTGKMMSISDLFSDKVEIEHLLPFSLTLDDSMANKTVCFRQANRDKGNRAPFDAFGNSPAGYDWQEILGRSQNLPYAKRWRFLPDAMKRFEADGGFLERQLNDTRYISRYTTEYISTIIPKNKIWVVTGRLTSLLRGFWGLNSILRGHNTDDGTPAKKSRDDHRHHAIDAIVVGMTSRGLLQKVSKAARRSEDLDLTRLFEGRIDPWDGFRDEVKKHIDAIIVSHRPRKKSQGALHNDTAYGIVEHAENGASTVVHRVPITSLGKQSDIEKVRDPLIKSALLNETAGLSGKSFENAVQKWCADNSIKSLRIVETVSIIPITDKEGVAYKGYKGDGNAYMDIYQDPTSSKWKGEIVSRFDANQKGFIPSWQSQFPTARLIMRLRINDLLKLQDGEIEEIYRVQRLSGSKILMAPHTEANVDARDRDKNDTFKLTSKSPGKLQSASARKVHISPTGLIREG

SEQ ID NO: 40 - protein, 1358 aa, Acidaminococcus sp.
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 41 - protein, 1358 aa, Acidaminococcus sp.; identical to SEQ ID NO: 40
  Acidaminococcus sp. D21

SEQ ID NO: 42 - protein, 1138 aa, Acidothermus cellulolyticus
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 43 - protein, 1045 aa, Acidovorax avenae
MQKEKPLAYRLALDLGSTSLGWAVLRLSAPGEPSAVIRAGSRIFSDGRNPKDGSSLAVTRRAARAMRRRRDRLLKRKARMLAALERHGFFPQDEAARKALEKLNPYGLRARGLESALKPEEFGRALFHLNQRRGFQSNRKTDRKDSDSGALKQAIGTLRAQMHESGCRTVGEWFWKVRMERKPEGVKGQGVRARYRETPFTTDEGKKRIDKRYDLYVDRAMVAQEFDALWAAQATFAPALFNEAARAELRDILLHQRKLRPVQPGRCTLVPEEPRALLALPSTQRFRIYQEVNHLRVLHDELREEALTLAQRDQIVALLERQAKVTFTAMRKALGFSALFNLEDAKRDGLKGNATTAALGKKDLFGPLWAGFDTALQDEIVTQLMTEESEPRLIAWLQEHTGVDEARAQAIANAGLPEGYGSLGRTALARIVPELQRDVITYDKAVQAAGFAHHSDLGFSFEHDADEVERIGERTIASTGEIKPVFAFKQLPYYGRALQRHVAFAKENPRNDEERYGKIANPTVHIGLNQVRVVVNALMCRYGRPTEVVIELARDLKQSREQKLEAQQRQADNQKRNARIRRSIAEVLGISEERVRTLDIQKWILWEELSHDAADRRCPYSGVQISASMLLGERVEIEHILPFSMTLDDSLNNRTVALREANRIKRNRTPWDARTDFEAHGWSYDGILQRAERMPQRKRHRFAPDGYERWLGEDKDFLARALNDTRYLSRVAAEYLRLVCPGSATRVIPGQMTALLRGKFGLNDVLGLDGEKNRNDHRHHAVDACVIGVTDQRMMQRFAQANAQAREDGLTRLVEDMPLPWPTYRAHVERAVRHIWVSHKPDHGFEGAMMEETSYGILRDGTIKQRRKADGSAGREISRLIRITEPSQPQRHGVDAEGRPLPYKGYVGGSNYCLEITVNDKGKWEGQVISTFDAYRIVREGGLRQLRHSTQGQNGQALAMRLVIGDSVRLEVDEQERVMRIVKINGNNGQVFMAPVHEANVDARNSDKNEAFAYTSKIAGSFQKTKARQVTISPIGELRDPGFKG

SEQ ID NO: 44 - protein, 1131 aa, Acidovorax ebreus
MAQHVFGLDIGIASVGWAILGEQRIIDLGVRCFDKAETAKEGDPLNLTRRQARLLRRRLYRRAWRLTQLSRLLKRKGLIADAKLFAKAPSYGDSAWELRRQGLDRLLTPLEWARVIYHQCKHRGFHWTSKAEEAKADSDAEGGRVKQGLAHTKALMQAKNYRSAAEMVLAEFPDAQRNKRGQYDKALSRVLLGEELALLFATQRRLGNPHASDFFEKLILGDGDRKSGLFWQQKPALSGADLLKMLGKCTFEKGEYRAPKASFSVERHVWLTRLNNLRIVVDGRSRPLNEAERQAALLLPYQTETSKYKTLKNAFIKAGLWGDGVRFGGLAYPSQAQIDAEKTKDPEDQFLVKLPAWHELRKAFKAAGHEALWQQISTPALDGDPTLLDQIATVLSVYKDGAEVVQQLRQLALPEPAASIAVLEKISFDKFSSLSLKALRRIVPLMQSGLRYDEAVAQIPEYGHHSQRIEPGAAKHLYLPPFYEAQRKYAGKGDHIGSMQFRDDADIPRNPVVLRALNQARKVVNALIREYGSPIAVNIEMARDLSRPLDERNKVKRAQEEFRDRNDRARSEFERDFGYKPKAAAFEKWMLYREQLGQCAYSQQPLDIQRVLDDHNYAQVDHALPYSRSYDDSKNNKVLVLTHENQNKGNRTAFEYLTSFPDGEDGERWRTFVAWVQGNKAYRMAKRNRLLRKNYGVDESKGFIDRNLNDTRYICKFFKNYVEEHLQLAARADGDTARRCVVVNGQLTAFLRARWGLTKVRGDSDRHHALDAAVVAACTHGMVKALADYSRRKEISFLQEGFPDPETGEILNPAAFDRARQHFPEPWTHFAHELKARLFTDDLAALREDMQRLGSYTTEDLGRLRTLFVSRAPQRRSGGAVHKETIYAQPESLKQQGGVIEKILLTSLKLQDFDKLLNPESNDHFVEPHRNERLYAAIRQRLEQFGGRADKAFGPDNLFHKPDKNNQPTGPVVRSIKLVRGKQTGIPIRGGLAKNDSMLRVDIFTKAGKFHLVPVYVHHRVTGLPNRAIVAFKDEDEWTLIDESFAFLFSVYPNDYVKVTLKKEQQSGYYSGADRSTGAMNLWAHDRAASVGKDGLIRGIGVKTALSVEKFNVDVLGRIYLAPPETRSGLA

SEQ ID NO: 45 - protein, 1056 aa, Actinobacillus minor
  Actinobacillus minor NM305
MKALNYILGLDLGIASVGWAVVEIDQNELPIRLIDLGVRTFERAEVPKTGDSLALARRLARSSRRLVRRRAVRLLKAKRLLKQEGILQADDFHSSHLKPLPNNPWELRVKGLNHLLDRKEWAAVLLHLLKHRGYLSQRKNESKTDNKELGALLKGVSENRQLLQAQAFSTPAEIAIKKFQQEEGHIRNQRGAYSHTFDRNDLLAELRLLFQKQREFNNPYTSQSLEQAIAELLMWQKPALSGEAILKMLGKCTFEPSEYKAPKNSYSAEYFVWLTKLNNLRILENGADRGLTAEERQLLINQPFEKAKFTYAQARKLLELSDLAIFKGVRYGKDNAESATLMEMKAWHAIRKALESNGLKTEWNGLKTKPELLDKIGTAFSIYKTDEDISQYLNGELSPAVLNALLENLSFDKFIRLSLQSLAKILPLMEQGLRYDEACKQVYGDHYGKKEQLELRFLPKIPVEDIRNPVVLRTLSQARKVINGVVRLYGSPARIHIETGREVGKSFSERRDISKRQEENRNERQRAVEKFKEFFPHFVGEPKAKDILKMRLYEQQHGKCLYSGKELDLNRLLEKGYVEIDHALPFSRTWDDSFNNKVLVLASENQNKGNQTPYEWLNGKENAERWKLFQALVNGSRFPYSKKQRILTKYLDEDGFRERNLNDTRYVARFLCNFIEDNMQLVGQGKKRVFASNGQITALLRRSWGIQKVREDNDRHHAVDAVVVACSTRALQKKITDYVRYKEMNVFTGEKIDQETGEIIKFHFPEPWKFFRQEVEIRVFSETPAEDVVIALPDRPQANHEFIQPLFVSRAPTRKMTGQGHMETIKSAKRLAEGLSVSRVPLTQLKLKDLENMVNREREKALYEALKVRLEKFNNDPAKAFADPFYKKGGQQVKAVRVEQVQKSGVLVRQENGVADNASMVRVDVFIKGGKYFLVPIYTWQVAKGILPNRAATQGKEEEYWDIMDETAIFQFSLYQNDLIKLVTKKKTIFGYFNGLNRATSNINIKEHDLDKSKGKDGIYLEVGVKLALSLEKYQVDELGKNIQPCRSMKKRPPVR

SEQ ID NO: 46 - protein, 1054 aa, Actinobacillus pleuropneumoniae
  Actinobacillus pleuropneumoniae serovar 10 str. D13039
MKLTPLNYILGLDLGIASVGWAVVEIDEQENPLGLIDVGVRTFDRAEVAKTGESLALARRLARSSRRLVKRRADRIKKVKRLLKSENILLSADEQLPNDVWQLRVKGLDQKLERQEWAAVLLHLLKHRGYLSQRKNESKSENKELGALRSGVAANHQILQSAEYRTPAEIAVKKFHVEEGHIRNQRGAYTHTFSRLDLLAEIELLFTRQTELGNPHTSAKLLENLTALLMWQKPALAGEAILKMLGKCTFEPTEYKAAKNSYSAERFVWLTKLNNLRILEQGAERALTDNERFALLDQPYEKAKFTYAQARTMLALPDEAIFKGVRYQGEDKKAVETKTILMEMKAYHQIRKALENADLKAEWNELKNNSELLDDIGTAFSLHKTDEDICRYLDGKLSESILNALLENLNFDKFIQLSLKALQQILPLMLQGQRYDEAVSAIYGDHYGKKSAEINRLLPTIPADEIRNPVVLRTLTQARKVINAVVRLYGSPARIHIETGREVGKSYQDRKKLEKQQEDNRKHRESAVQKFKEYFPNFVGEPKGKDILKMRLYELQQAKCLYSGKSLELHRLLEKGYVEVDHALPFSRTWDDSFNNKVLVLANENQNKGNLTPYEWLDGKNNSEPWQNFVARVQTSGFSHTKKQRILSHKLDEKGFIERNLNDTRYVVRFLCNFIADNMLLTGKGKRKVFASNGQITALLRGRWGLQKVRDDNDRHHALDAVVVACSTVAMQQKITRFVRYEEGNVFSGERIDRETGEIIPLHFPSPWAFFRENVEIRIFSENPKLELENRLPDYPQYNHEFVQPLFVSRMPTRKMTGQGHMETVKSAKRLDEGLSVLKVPLTQLKLNDLERMVNREREMALYESLKVRLEQFDNDPAKAFAEPFYKKGGALVKAVRVEQTQKSGVLVRDGNGVADNASMVRVDVFTKAGKYFLVPIYTWQVAKGILPNKAVTANVDEIDWLEMDESYQFIFTMYPNDLVKVKLKKEEFFGYYGGLDRATGAIVIKEHDLEKSKGRQGIYRIGVKLALSFEKYQVDELGKNIRPCRPTKRQHVR

SEQ ID NO: 47 - protein, 1062 aa, Actinobacillus succinogenes
MNLNYILGLDLGIASVGWAVVEIDEQENPQRLIDVGVRTFDRAEVLKTGESLALARRLARSSRRLVKRRAERIKKAKRLLKAENLLLSADEILPNEAWQLRVKGLDQKLERQEWAAVLLHLLKHRGYLSQRKNESKSENKELGALLSGVAINHQILQSAEYRTPAEIAVNKFQAEEGHIRNQRGAYTHTFSRLDLLAEMELLFQRQATLGNPHTSTKLLENLTALLMWQKPALAGEAILKMLGKCTFEPTEYKAAKNSYSAERFVWLTKLNNLRILEQGAERALTDNERFALLDQPYEKAKLTYAQVRTLLGLSDEAIFKGLRYQGEDKKAVETKTTLMEVKAYHQIRKALEGLDLKAEWNELKNNPALLDEIGTAFSLYKTDDDIHRYLDGKLSESVLNALLENLNFDKFIQLSLKALQQILPLMLQGQRYDEAVSAIYGDHYGKKSDEIDRLLPNIPTDEIRNPVVLRTLTQARKVINAVVRLYGSPARIHIETGREVGKSYQDRKKLEKQQEENRKQRENAVKKFKEYFPNFVGEPKGKDILKMRLYELQQAKCLYSGKSLELYRLLEKGYVEVDHALPFSRTWDDSFNNKVLVLANENQNKGNATPYEWLDGKNNSEGWQHFVARVQTSGFSYAKKQRVLIQELDEKSFIERNLNDTRYVARFLCNHIADNMLLTGKGKRKVFASNGQITALLRGCWGLQKVRENNDRHHALDAVVVACSTKSMQDKITKFVKYKEGRLFKDKKDGVYKGERINRETGEIISLHFPTPWKFFKENVEIRIFSENPKLELENRLPDYPQYNHEFVQPLFVSRMPTRKMTGQGHMETVKSAKRLDKGLSVLKVPLTQLKLSDLERMVNREREMALYEALKECLEQFGNDPAKAFAEPFYKKGGALVKAVRVEQTQKSGVLVRNGNGVADNATGSIVRVDVFTKGGKYFLVPIYTWQVAKGILPNKAVIQGKDESEWEEMDENAVFQFSMHKNDLIKVKTKKGEIFGYFNGLDRATGSIEIEEHDLEKSKGKNGSHRGLGVKTAFFLEKYQVDELGKNIRPCRPTKRQHVR

SEQ ID NO: 48 - protein, 1054 aa, Actinobacillus suis
MKLTPLNYILGLDLGIASVGWAVVEIDEQENPLGLIDVGVRTFDRAEVPKTGESLALARRLARSARRLVKRRADRIKKAKRLLKAENILLSADEHLPNDVWQLRVKGLDQKLERQEWAAVLLHLLKHRGYLSQRKNESKSENKELGALLSGVETNHQILQSAEYRTPAEIAVKKFHVEDGHIRNQRGAYTHTFSRLDLLAEMELLFQRQTDLGNPHTSAKLLENLTALLMWQKPALAGEAILKMLGKCTFEPTEYKAAKNSYSAERFVWLTKLNNLRILEQGAERALTDNERFALLDQPYEKAKFTYAQARTMLALPDEAIFKGVRYQGEDKKAVETKTILMEMKAYHQIRKALENADLKAEWNELKNNSELLDDIGTAFSLHKTDEDICRYLDGKLSESILNALLENLNFDKFIQLSLKALQQILPLMLQGQRYDEAVSAIYGDHYGKKSAEINRLLPTIPADEIRNPVVLRTLTQARKVINAVVRLYGSPARIHIETGREVGKSYQDRKKLEKQQEDNRKQRESAVKKFKEYFPNFVGEPKGKDILKMRLYELQQAKCLYSGKSLELHRLLEKGYVEVDHALPFSRTWDDSFNNKVLVLANENQNKGNLTPYEWLDGKNNSEHWQNFVARVQTSGFSHTKKQRILSHKLDEKGFIERNLNDTRYVARFLCNFIADNMLLTGKGKRKVFASNGQITALLRGRWGLQKVRDDNDRHHALDAVVVACSTVVMQQKITRFVRYEEGNVFSGERIDRETGEIIPLHFPSPWAFFRENVEIRIFSENPKLELENRLPDYPQYNHEFVQPLFVSRMPTRKMTGQGHMETVKSAKRLDEGLSVLKVPLTQLKLSDLERMVNREREVTLYESLKARLEQFGNDPAKAFAEPFHKKGGAVVKAVRVEQTQKSGVLVRDGNGVADNASMVRVDVFTKGGKYFLVPIYTWQVAKGILPNKAVTANVDEIDWLEMDESYQFIFTMYPNDLVKVKLKKEEFFGYYGGLDRATGAIVIKEHDLEKSKGKQGIYRIGVKLALSFEKYQVDELGKNIRPCRPTKRQHVR

SEQ ID NO: 49 - protein, 1105 aa, Actinomyces coleocanis
  Actinomyces coleocanis DSM 15436
MDNKNYRIGIDVGLNSIGFCAVEVDQHDTPLGFLNLSVYRHDAGIDPNGKKTNTTRLAMSGVARRTRRLFRKRKRRLAALDRFIEAQGWTLPDHADYKDPYTPWLVRAELAQTPIRDENDLHEKLAIAVRHIARHRGWRSPWVPVRSLHVEQPPSDQYLALKERVEAKTLLQMPEGATPAEMVVALDLSVDVNLRPKNREKTDTRPENKKPGFLGGKLMQSDNANELRKIAKIQGLDDALLRELIELVFAADSPKGASGELVGYDVLPGQHGKRRAEKAHPAFQRYRIASIVSNLRIRHLGSGADERLDVETQKRVFEYLLNAKPTADITWSDVAEEIGVERNLLMGTATQTADGERASAKPPVDVTNVAFATCKIKPLKEWWLNADYEARCVMVSALSHAEKLTEGTAAEVEVAEFLQNLSDEDNEKLDSFSLPIGRAAYSVDSLERLTKRMIENGEDLFEARVNEFGVSEDWRPPAEPIGARVGNPAVDRVLKAVNRYLMAAEAEWGAPLSVNIEHVREGFISKRQAVEIDRENQKRYQRNQAVRSQIADHINATSGVRGSDVTRYLAIQRQNGECLYCGTAITFVNSEMDHIVPRAGLGSTNTRDNLVATCERCNKSKSNKPFAVWAAECGIPGVSVAEALKRVDFWIADGFASSKEHRELQKGVKDRLKRKVSDPEIDNRSMESVAWMARELAHRVQYYFDEKHTGTKVRVFRGSLTSAARKASGFESRVNFIGGNGKTRLDRRHHAMDAATVAMLRNSVAKTLVLRGNIRASERAIGAAETWKSFRGENVADRQIFESWSENMRVLVEKFNLALYNDEVSIFSSLRLQLGNGKAHDDTITKLQMHKVGDAWSLTEIDRASTPALWCALTRQPDFTWKDGLPANEDRTIIVNGTHYGPLDKVGIFGKAAASLLVRGGSVDIGSAIHHARIYRIAGKKPTYGMVRVFAPDLLRYRNEDLFNVELPPQSVSMRYAEPKVREAIREGKAEYLGWLVVGDELLLDLSSETSGQIAELQQDFPGTTHWTVAGFFSPSRLRLRPVYLAQEGLGEDVSEGSKSIIAGQGWRPAVNKVFGSAMPEVIRRDGLGRKRRFSYSGLPVSWQG

SEQ ID NO: 50 - protein, 1113 aa, Actinomyces georgiae
  Actinomyces georgiae F0490
MSASSQNVERIRYKVGIDVGLRSIGFCAVQVDADDRPVKLLNTVVHVHDAGVSPADAKKADTRKLVSGVARRTRRLYRTRKRRLVDLDRQLDGLGWPLVDPARFADPREPWFAREKLVSGRVDDADERKELLSVALRHIAHHRGWRNPYSTVESLQADAPPSEFLQGLNQRVSEKLGTELDPGLTQGQLVAKLLHRFPNAKIRGPEGILRGKLHQSDNAGELRLICRTQGLDCHITEELVRLVFQAKSPKANKEMRKRIGRDQLPGQGAHIRAEKAHPVFQRFRIVAVLANLRIREAHVDRRLTAEEMRTLTDFLLGLAGSEQPTWEELADNLNIERHQLRGTAKASVDGAPALRFPPIDATTDRIYASKLKWLAEWWRQADEERRGYMVDALSNSGGSEDEPYLDDEIAEMLEQASEEDQAKLDSLHLPGGRASYCLDTLRRLTDAMLGGGLDLFEARKAVFHVDDDWAPPTDPIGAPVGNPPVDRVLKHVARWLEAATGRWGAPQTINIEHVREGLGSEKAARELTRMNDRRRRNNQKLVEEMGEKLGMSGRIRRSDRMRYEAIRRQNCECLYCGQPITYQTMEMDHIVPRAGAASTNSRSNLAAVCRRCNHQKGKLPFAVWAESQDSPAEVRLQDAVQRVRHWLRDAGMGQKELQALRVQVIARLKSKRPDEEFDGRSMESIAWMANELRARVEAQYRGSGTTVRVYRGALTAEARKASGFEGRVNLIGGRGKDRFDRRHHAMDALVIALMNQSVAQTLALRLNMRDSQWLTQSEQTWRQFHGAPGEAARKWEAWDRDMRDASDLFNLALDGGRIPITENVRLRVGNGRVHEDGVIRFKPEYEVKGKTIKGGEARLLGDSLPSEQIDRAETPALWTALTRLPEYDRKSGLPENPDRVIRVNGAVVQATDRIRFFGTPASVAVRGGYAKLGESIHHARIYRINGKTPKYAMIRVYTIDLMRLNHEDIFTAVLKPSTISMRCAEKKLKYAIAEGNAEQIGWLVEGDQLELDAAAYAKGVGADLMREYPMATCWRVAGFPDEAKLRLRPVLLAAEGMGEDAPKFMREVLENQGWRPAVNALLSPGSVRVVRRNVLGEPRFKSSGHLPTTVDLV

SEQ ID NO: 51 - protein, 1101 aa, Actinomyces naeslundii
  Actinomyces naeslundii str. Howell 279
MWYASLMSAHHLRVGIDVGTHSVGLATLRVDDHGTPIELLSALSHIHDSGVGKEGKKDHDTRKKLSGIARRARRLLHHRRTQLQQLDEVLRDLGFPIPTPGEFLDLNEQTDPYRVWRVRARLVEEKLPEELRGPAISMAVRHIARHRGWRNPYSKVESLLSPAEESPFMKALRERILATTGEVLDDGITPGQAMAQVALTHNISMRGPEGILGKLHQSDNANEIRKICARQGVSPDVCKQLLRAVFKADSPRGSAVSRVAPDPLPGQGSFRRAPKCDPEFQRFRIISIVANLRISETKGENRPLTADERRHVVTFLTEDSQADLTWVDVAEKLGVHRRDLRGTAVHTDDGERSAARPPIDATDRIMRQTKISSLKTWWEEADSEQRGAMIRYLYEDPTDSECAEIIAELPEEDQAKLDSLHLPAGRAAYSRESLTALSDHMLATTDDLHEARKRLFGVDDSWAPPAEAINAPVGNPSVDRTLKIVGRYLSAVESMWGTPEVIHVEHVRDGFTSERMADERDKANRRRYNDNQEAMKKIQRDYGKEGYISRGDIVRLDALELQGCACLYCGTTIGYHTCQLDHIVPQAGPGSNNRRGNLVAVCERCNRSKSNTPFAVWAQKCGIPHVGVKEAIGRVRGWRKQTPNTSSEDLTRLKKEVIARLRRTQEDPEIDERSMESVAWMANELHHRIAAAYPETTVMVYRGSITAAARKAAGIDSRINLIGEKGRKDRIDRRHHAVDASVVALMEASVAKTLAERSSLRGEQRLTGKEQTWKQYTGSTVGAREHFEMWRGHMLHLTELFNERLAEDKVYVTQNIRLRLSDGNAHTVNPSKLVSHRLGDGLTVQQIDRACTPALWCALTREKDFDEKNGLPAREDRAIRVHGHEIKSSDYIQVFSKRKKTDSDRDETPFGAIAVRGGFVEIGPSIHHARIYRVEGKKPVYAMLRVFTHDLLSQRHGDLFSAVIPPQSISMRCAEPKLRKAITTGNATYLGWVVVGDELEINVDSFTKYAIGRFLEDFPNTTRWRICGYDTNSKLTLKPIVLAAEGLENPSSAVNEIVELKGWRVAINVLTKVHPTVVRRDALGRPRYSSRSNLPTSWTIE

SEQ ID NO: 52 - protein, 1144 aa, Actinomyces sp.
  Actinomyces sp. ICM47
MSMIDSSENVPGIRYRVGIDVGLKSIGFCAVEVDRNDQPVRMLNSMVFIHDAGVDPNENKAAKSRKLTAGVARRTRRLYRTRHQRLVNLDRVLSKEFGWPLPDLTSFKDPREPWHVRAGLLEGYIADDEKRKEALSIALRHIARHRGWRNPYAKVETLLQPSEPSDFLKGLNDRISEELGRAFPADATPGQLVDTYLAHPDYVGRAGTPKLRGPQGILAGKLHQSDNAQEIRGICDVQRIEPAERDRLIRVVFEAKSPKGSAKERGLVGYDELPGQGRHVRAEKAHPAFQLFRMVSVLANLRIREGREERPLTPDELEDLVDFINQVSLKQEVTWQDLADKLRIERADLRGTAKASFDGSPVLRNPPTDVTTEKIMACKVKWLKEWWKEADDEQRGYMVDAFSNSGGSEDGTDVNDEVAELLEQATEDDQLEFEKISLPQGRAAYSLDSLRRLTDRMLRDGVDLHTARRLEFNVGDDWKPAVEPIGAPTGNPAVDRVLKQVSRWLHAATERWGEPTVINIEHARDGLGSERVARELMRENEKRRKANASAVAEMAAKLKLSGKVHRSDQIRYFALQRQNCQCLYCGAPITYTTAEMDHIVPRADGSSTNDRSNLAAVCRTCNHMKGKIPFAVWASSDKANQGVSLTGALERVNMWQRDSGMSPRQLKQLQREVCARLKSKKPDQEFDGRSMESVAWMAVELRTRIEGFYRSRDEESVPSVGVYRGQLTAEARRASGFESRVNLIGGRGKTRFDRRHHAMDALVIALMNPSVSRTLALRLNMRDAQRLTGVEETWKHFYGKPGEASKRFESWRESMLRGVELFNIALSDNAIPFVENIRLRVGSSVIHDATVHSFCPPKTPDGKQIITKGYGEQHSLGSAMPVELIDRAETPALWTALTRCPDFDPKKGLPENPQRTISVNGTRVGPTELVNFFEFSKSGPKACLKVRGGYVDLSGAIHHARIYRIAGKKTAYAMIRVFQVDLLRLKDHDVFTTPLKPSTISMRTAEPKIREALANGTATQIGWLVEGDELVIDTSKYSGGFIGEVLARYPEATSWRVAGFMTPAKLRIKPILLSKEGFVDETQAALLGVEVTSEAIQKTVDRPGWLPAVNVLFGAGGVRVIRRNCLGEERYHSSASLPVSMTLE

SEQ ID NO: 53 - protein, 1095 aa, Actinomyces sp.
  Actinomyces sp. oral taxon 175 str. F0384
MPAHHLRVGIDVGTHSVGLATLRVDDQGTPIELLSALSHIHDSGIGKEGQKDHDTRKKLSGVARRTRHLLRNRRERLQQLDKVLVDLGFPIPKPEEYPDLSERTDPYRVWRVRARLVEETLPEELRGPAISMAVRHIARHRGWRNPYSKVESLLSPAEESSFMKALRKRIMTKTGEVLDDDITPGQAMAQVALTHKIYMRGPEGILGKLHQSDNANEIRKICARQGISSDVCKQLLRAVFKAESPRGSAVSRVAPDPLPGQGSFRRAPKCDPEFQRFRIISIVANLRISETKGENRPLTVDERRQVVAFLMEDSQADLTWVDVAEKLRVSRQALRGTAMLTADGERSAAQPPIDVTDQIMRKTKISALKTWWDKADAERRGAMVRYLYEGLEDSECAEVIAKLPEKDHAKLDSLHLPAGRAAYSRESLTALSDHMLETTNDLHEARKRLFGVDDSWAPPAEPVGAPVGNPSVDRTLKIVARYLSAVESIWGTPEVIHVEHVRDGFTSERTAEERDKANRSRHNDNQKAIEKIQHDYGKEGYISRGDIVRFHALKLQGSACLYCGTTIGYHTCQLDHIVPQAGPGSNNRRGNLVAVCERCNHSKSNTPFAVWAQKCGIPHVGVKEAISRVNGWVEHNHSTSSGDLTRLKKEVIARLRRTQKDPEIDERSMESVAWMANELHHRIAAAYPETTVMVYRGSITAAARKAASIESRINLIGEKGRKDRLDRRHHAVDASVVALMEPSVAKTLAERSSLRGEQRLTGQEQTWKQYTGLTVGARERFEAWRGHMHRLTELFNESLAADEVYVTQNIRLRLSDGSAHTVKASKLVSHRLGDGLTVQQIDRACTPALWCALTREIDFDEKNGLPAREDRVIRVHGQEISSADCIQVFSKRKKTKSDRDEAPFGAIAVRGGFVEIGSSIHHARIYRIEGEKPAYAMLRVFTHDLLSQRHGDLFSAVIPPQSISMRCAATELRQAISEGRATYLGWIVSGDELHIPVETFTTHKIGSFLKDYPNTTRWRICGYDSETMLILKPRILSAEGLNNSSDIAEYVIKNKGWRVAINKLAKVHPTVVRRDALGRPRHSSRSNLPVTWSIE

SEQ ID NO: 54 - protein, 1181 aa, Actinomyces sp.
  Actinomyces sp. oral taxon 180 str. F0310
MLHCIAVIRVPPSEEPGFFETHADSCALCHHGCMTYAANDKAIRYRVGIDVGLRSIGFCAVEVDDEDHPIRILNSVVHVHDAGTGGPGETESLRKRSGVAARARRRGRAEKQRLKKLDVLLEELGWGVSSNELLDSHAPWHIRKRLVSEYIEDETERRQCLSVAMAHIARHRGWRNSFSKVDTLLLEQAPSDRMQGLKERVEDRTGLQFSEEVTQGELVATLLEHDGDVTIRGFVRKGGKATKVHGVLEGKYMQSDLVAELRQICRTQRVSETTFEKLVLSIFHSKEPAPSAARQRERVGLDELQLALDPAAKQPRAERAHPAFQKFKVVATLANMRIREQSAGERSLTSEELNRVARYLLNHTESESPTWDDVARKLEVPRHRLRGSSRASLETGGGLTYPPVDDTTVRVMSAEVDWLADWWDCANDESRGHMIDAISNGCGSEPDDVEDEEVNELISSATAEDMLKLELLAKKLPSGRVAYSLKTLREVTAAILETGDDLSQAITRLYGVDPGWVPTPAPIEAPVGNPSVDRVLKQVARWLKFASKRWGVPQTVNIEHTREGLKSASLLEEERERWERFEARREIRQKEMYKRLGISGPFRRSDQVRYEILDLQDCACLYCGNEINFQTFEVDHIIPRVDASSDSRRTNLAAVCHSCNSAKGGLAFGQWVKRGDCPSGVSLENAIKRVRSWSKDRLGLTEKAMGKRKSEVISRLKTEMPYEEFDGRSMESVAWMAIELKKRIEGYFNSDRPEGCAAVQVNAYSGRLTACARRAAHVDKRVRLIRLKGDDGHHKNRFDRRNHAMDALVIALMTPAIARTIAVREDRREAQQLTRAFESWKNFLGSEERMQDRWESWIGDVEYACDRLNELIDADKIPVTENLRLRNSGKLHADQPESLKKARRGSKRPRPQRYVLGDALPADVINRVTDPGLWTALVRAPGFDSQLGLPADLNRGLKLRGKRISADFPIDYFPTDSPALAVQGGYVGLEFHHARLYRIIGPKEKVKYALLRVCAIDLCGIDCDDLFEVELKPSSISMRTADAKLKEAMGNGSAKQIGWLVLGDEIQIDPTKFPKQSIGKFLKECGPVSSWRVSALDTPSKITLKPRLLSNEPLLKTSRVGGHESDLVVAECVEKIMKKTGWVVEINALCQSGLIRVIRRNALGEVRTSPKSGLPISLNLR

SEQ ID NO: 55 - protein, 1103 aa, Actinomyces sp.
  Actinomyces sp. oral taxon 181 str. F0379
MTKINDDLRYRVGIDVGLKSIGFCAVEVDENDQPLRLLNSMVFVHDAGVDPNENKAAKSRKLTAGVARRTQRGTAQNRRRLAELDRALSEELNWPLPNLEDFEDSYEPWHTRAELVEHYIKDDAERAEALAIAIRHIARHRGWRNPYLSVDSLLTPQEPSKFLRGLNERVTQALGREFPADATPGQLICAYIDSPKYAETQGIRGDSGILSGKLHQFDNVGEIRKICEVQRLDHDVFKLLVRKVFFAKSPRGSAAGLVGHDQIPGQGKYIRAEKAHPDFQLFRIVAVLTNLRIREGKAERCLTPDELRGLVDYILEVQLKQQVTWADLADNLGIERTDLRGTARASFDGSPALRFPPTDVTAEKIMASKVKWLKDWWDKADSERRGFMVDALSNSGGSTGDNDIDDEVAALLEAATEDEQAELEKIQLPQGRAAYSLDSLRRLTKRMLEEGVDLHTARKEEFNVDDDWRPEPEPIEAPVGNPAVDRVLKQVARWLNMATDRWGVPDVINIEHTRDGLGSEKVARELLRESQKRQDLNQKDMDKMIRELGISGKARRSSLIKYQAIQRQNSMCLYCGTEIGFETAEMDHIVPRALSGSTNDRSNLAAVCRACNHQKGAVPFAVWATSGEAHAGVSLEDAIKRVRLWQKGPGMSPKQHKAFQNEVISRLKSRKPDEEFDGRSMESVAWMAVELRTRIDGYYRKVNSDSVPKVGIYRGQLTAEARKASGFENRVNLIGGKGKTRFDRRHHAMDALVIAMMNQSVSQTLALRVNMRESQRITGQEETWKNFYGKPGQASERFEKWREGMLRAVELFNIELAKNAIPFHENVRLRVGSSKVHDDTVRKFIHAKLGEALSVAMIDCAETPALWTALTRLPDFDPKDGLPEDLSREIYIHSRKITADEQLNFFNSPSACLKVRGGYVEIGSSIHHARVYRIDGKKTTYSMVRVFATDLVKMTHEDVFTTPLKPSTISMRTADPKIRKALADGTATQIGWLVEGDELQLETDKYSGGLIGEVLAEYPQLTSWRVAGFYGVTQLRLRPYMLAAEGIPSDASESLRKVIEGKGWLPAINALLSSGCVKVVRRNCLGEPRFNAKSSLPVSQLLR

SEQ ID NO: 56 - protein, 1120 aa, Actinomyces sp.
  Actinomyces sp. oral taxon 848 str. F0332
MNAMKQYNAGIDVGINSVGFAAIEVDSKGLPLNILNNMVVLHDSGVDPGTAKTGATRLANSGTARRTRKLIARRRKRLQKLDRYIEVQGWPLVDFSSLPDPYTPWKIRAKLTQDRLEGEEQGRGLSIALRHMARHRGWRNPYEGVESLHSPKEASKQFKDLKDRVTKVSGVIFDEDATPAEVVCDIGLSPKQRLRSAPSAKYKEGATLADEPVGGKSKEGLLGGKLMQSDNANELRKIGIVQGLSNEKVNEIIDQVFASESPKGQAGKRAKKDELPGQEQYVRALRAHLAFQRFRIVAAVANLRILEAEPKHERLLSQSEKDKVIEFLMSADGDDGVTWSDVAEELGIERECLSGTAKRGADGERPSSFPPTNSTNISIVRSKVKPLIEWWRKASDDEQATLVTALSNADELTDDQPSAETVRQFLSSPDEQSQEKIDKISLPKGRAAYSVNSLERLTRRMLKDSVDLFEARKREFGVDNNWTPTPDSIGEPVGNPAVDRVLKIVNRWLLAVTRKWGPPKVVNIEHVRVGFTSAAQTRKYEEENKTNRERNLAILEELRDKFGTSGKIRREDITRFAALRRQNCQCAYCGEAITFFDCEMDHIVPRKGPGSTNTRNNLVAICERCNKSKSNMPFSLWAQNCDIPGVSVEAVIDRVRTWIKDPELNPKQYNNFKKDVIERLRKTVDDDAIDNRSIESVAWMATELADRIGSHFRTAGANTKVRVYRGWLTSEARKASGFEGKINLIGGRGKTRLDRRHHAMDAATIALMRQSVAQTLVERASIRESDRLRRVVSSSWKDYRGADRDKQFSYGSWLNSMNALAELFNRAIDADGIPVTQNLRLRLGNGEAHDATIRSLEKKRVGASWTIGEIDRASTPQLWLALTRQEDFDQNDGLPANASRELRVKNHWFHAEENVTLFPTKSAAIAVRGGYAEIGNTIHHARLYKLPGKKLTYGMIRVFAIDLLCAWHTDLFSSPLLPESISLRTAETKVRRAVEDGAAMYIGWLVDGDEIVLDPETKAFKSNKIGEYLCEFPGTKRWKVDGFPDKEKLRLRPLQLAGEGLPEDVSAGTEEILGPKGNGWRVAINALFKSSQLVVVRRTALGMVRKLSRRHLPLTTRLRG

SEQ ID NO: 57 - protein, 1114 aa, Actinomyces turicensis
  Actinomyces turicensis ACS-279-V-Col4
MQFHFYMVYVTMKGMNDKDASQQLRYRVGIDVGTHSIGFCAVEVDESGMPIQLLNSMVHKHDSGIDPGGNDTATTRLAEAGVARRTRRLIRRRKKRLQELDAFIEECGWPLVDLATITDARSPWRIRAHLATEHIDDEAEQGKLLSIALRHMARHRGWRSPYARISSLHIQADPSEQLKALAQRVSEKTGISLTADQTPAQLISVYLDVFETGKLRGPEGILGGKLMQSDNANELRRIATVQGLDNDLLKKIIGFVFAAESPKGSAAKRVGKDVLPGAHGLRAEKAHPAFQQFRIVSIVQNLRIKEGTGLRALTSEETEIVVDFLNQAGLTEAPTWEEVADNLEIPRSHLKGTATEGFDGIAPSTRPPFDVTSQKILNGKLKKLSAWWKDADYDHRCAMVNALSNVGSDDEGSLADDDVREFLSDFTDEELEALDKVELPGGRAAYSVDSLEKLTNTMLSEGCDLHSARKIAFGVDDSWTPPAEPIGQPVGNPAVDRVLKQVARWISAATNQWGTPESVNIEHVRDALGSEKASREYQRSLQTRRIRNEKLFAEMRERLDIGGKPRRSELTRYLALQRQNCQCLYCGMPITYTDAEMDHIVPRKGAASTNTRENFAAVCRACNHQKSNLPFAVWAEKTERPGVSVKEAYKRVSDMRIEPGMNGRQMNEFRKAIRLRLTTKHADAEIDGRSLESVAWMANELRHRIEGFYRSAENDVTVRVFRGAVTAEGRRASGFESRVNLIGGKGKTRLDRRHHAMDALTIALMEPGIAQTIALRMNMRESQRVLGEQETWKSFTGGSDTARKRWEHWCEEMLRASELFNVFLAEDRIPICQNKRLRLGSSAVHKAIVQPFEASDKRIVSDAMPVELIDRASTPALWTALTRDPDFDPKEGLPANPSRTIRLHDKRLGPNETVEFFPTAAACLAIRGGYCEIGAGIHHARIFRISGKKTTYAMLRVYQCDLVRFQKENLLTVELPANTISVRTAVPKLREALAHGTAEQIGWLVVGDELKIDLSGFTTGQIETFNETYPQATRWEVTGFPTKTQLRLKPLLIASEGLADDVPDDIVKIVKGPGWWPAIDKLLKIGNVVLYRRDTHGKPRVVSHRSLPLSSKLQ

SEQ ID NO: 58 - protein, 1101 aa, Akkermansia muciniphila
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 59 - protein, 1113 aa, Alcanivorax pacificus
  Alcanivorax pacificus W11-5
MRYRVGLDLGTASVGAAVFSMDEQGNPMELIWHYERLFSEPLVPDMGQLKPKKAARRLARQQRRQIDRRASRLRRIAIVSRRLGIAPGRNDSGVHGNDVPTLRAMAVNERIELGQLRAVLLRMGKKRGYGGTFKAVRKVGEAGEVASGASRLEEEMVALASVQNKDSVTVGEYLAARVEHGLPSKLKVAANNEYYAPEYALFRQYLGLPAIKGRPDCLPNMYALRHQIEHEFERIWATQSQFHDVMKDHGVKEEIRNAIFFQRPLKSPADKVGRCSLQTNLPRAPRAQIAAQNFRIEKQMADLRWGMGRRAEMLNDHQKAVIRELLNQQKELSFRKIYKELERAGCPGPEGKGLNMDRAALGGRDDLSGNTTLAAWRKLGLEDRWQELDEVTQIQVINFLADLGSPEQLDTDDWSCRFMGKNGRPRNFSDEFVAFMNELRMTDGFDRLSKMGFEGGRSSYSIKALKALTEWMIAPHWRETPETHRVDEEAAIRECYPESLATPAQGGRQSKLEPPPLTGNEVVDVALRQVRHTINMMIDDLGSVPAQIVVEMAREMKGGVTRRNDIEKQNKRFASERKKAAQSIEENGKTPTPARILRYQLWIEQGHQCPYCESNISLEQALSGAYTNFEHILPRTLTQIGRKRSELVLAHRECNDEKGNRTPYQAFGHDDRRWRIVEQRANALPKKSSRKTRLLLLKDFEGEALTDESIDEFADRQLHESSWLAKVTTQWLSSLGSDVYVSRGSLTAELRRRWGLDTVIPQVRFESGMPVVDEEGAEITPEEFEKFRLQWEGHRVTREMRTDRRPDKRIDHRHHLVDAIVTALTSRSLYQQYAKAWKVADEKQRHGRVDVKVELPMPILTIRDIALEAVRSVRISHKPDRYPDGRFFEATAYGIAQRLDERSGEKVDWLVSRKSLTDLAPEKKSIDVDKVRANISRIVGEAIRLHISNIFEKRVSKGMTPQQALREPIEFQGNILRKVRCFYSKADDCVRIEHSSRRGHHYKMLLNDGFAYMEVPCKEGILYGVPNLVRPSEAVGIKRAPESGDFIRFYKGDTVKNIKTGRVYTIKQILGDGGGKLILTPVTETKPADLLSAKWGRLKVGGRNIHLLRLCAE

SEQ ID NO: 60 - protein, 1029 aa, Alicycliphilus denitrificans
  Alicycliphilus denitrificans BC
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 61 - protein, 1029 aa, Alicycliphilus sp.; identical to SEQ ID NO: 60

SEQ ID NO: 62 - protein, 1146 aa, Alicyclobacillus hesperidum
  Alicyclobacillus hesperidum URH17-3-68
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 63 - protein, 1052 aa, Aminomonas paucivorans
  Aminomonas paucivorans DSM 12260
MIGEHVRGGCLFDDHWTPNWGAFRLPNTVRTFTKAENPKDGSSLAEPRRQARGLRRRLRRKTQRLEDLRRLLAKEGVLSLSDLETLFRETPAKDPYQLRAEGLDRPLSFPEWVRVLYHITKHRGFQSNRRNPVEDGQERSRQEEEGKLLSGVGENERLLREGGYRTAGEMLARDPKFQDHRRNRAGDYSHTLSRSLLLEEARRLFQSQRTLGNPHASSNLEEAFLHLVAFQNPFASGEDIRNKAGHCSLEPDQIRAPRRSASAETFMLLQKTGNLRLIHRRTGEERPLTDKEREQIHLLAWKQEKVTHKTLRRHLEIPEEWLFTGLPYHRSGDKAEEKLFVHLAGIHEIRKALDKGPDPAVWDTLRSRRDLLDSIADTLTFYKNEDEILPRLESLGLSPENARALAPLSFSGTAHLSLSALGKLLPHLEEGKSYTQARADAGYAAPPPDRHPKLPPLEEADWRNPVVFRALTQTRKVVNALVRRYGPPWCIHLETARELSQPAKVRRRIETEQQANEKKKQQAEREFLDIVGTAPGPGDLLKMRLWREQGGFCPYCEEYLNPTRLAEPGYAEMDHILPYSRSLDNGWHNRVLVHGKDNRDKGNRTPFEAFGGDTARWDRLVAWVQASHLSAPKKRNLLREDFGEEAERELKDRNLTDTRFITKTAATLLRDRLTFHPEAPKDPVMTLNGRLTAFLRKQWGLHKNRKNGDLHHALDAAVLAVASRSFVYRLSSHNAAWGELPRGREAENGFSLPYPAFRSEVLARLCPTREEILLRLDQGGVGYDEAFRNGLRPVFVSRAPSRRLRGKAHMETLRSPKWKDHPEGPRTASRIPLKDLNLEKLERMVGKDRDRKLYEALRERLAAFGGNGKKAFVAPFRKPCRSGEGPLVRSLRIFDSGYSGVELRDGGEVYAVADHESMVRVDVYAKKNRFYLVPVYVADVARGIVKNRAIVAHKSEEEWDLVDGSFDFRFSLFPGDLVEIEKKDGAYLGYYKSCHRGDGRLLLDRHDRMPRESDCGTFYVSTRKDVLSMSKYQVDPLGEIRLVGSEKPPFVL

SEQ ID NO: 64 - protein, 1361 aa, Anaerococcus tetradius
  Anaerococcus tetradius ATCC 35098
MGNYYLGLDIGTNSVGWAVTDENYNIERFKKKNMWGIRLFDEAKTAESRRIHRQARRMRQRKIQRLNLLMELFDVEISKVDESFFIRKKESDLHYEDKSQDSRYALFNDKEFNDKDYHNKYPTIFHLIMDLIENDEKKDIRLLYLACHYLIKNRGHFIFEGQKFDVNSSLNNNINKLKSHLDQFYNICLDFDNDKLIEILVNQNLNISEKSKKIKELLRKTNLEVGIANLIAGGSIKLSNMFDDDELKNLDYNSLSFKNSNFDEGRELFEEVLEDRFELVEILKDIHDASVLETMLSSASISPDGGKYISSSMINSYNKHKRDLKLLKKIIKKYKKSEYDNIFRDENIKNNYLSYTRTGINKNKKVQAEDNTDSDGFYKYIVKILKDIKENDSDEDIKYILSEIDKKNFVPKQRTKENSVIPYQLREIELRKIIDNQSKYHKFLNEVDEKGISVKEKIISLLTFRIPYYIGPLNPSYNEEKNFTTSWVKRLAKGKVTPWNFEDMVDIDASREAFIENKLNKCSFLLDETVLPKDSLLYQEYMVLNELNNLKINGQSINTDLKKSIYEELFKKYKKVTRKRLISYIKEKENMSGDIVITGIDGDFKQGLKSYIAFKDIIGEKIDDDIYRKEVEKIIRDISLYGDDKSFIQKKIKNENKLDLSDDQISKIAKLKFKDWGRFSKKLLVGIKASDKNTGEIDNIIGFMRNYNYNIMQLMANVFTFKDEIEKLNSKYYTDEKINIDYLDDLYLSSPAKRMLWQSFQIVDEIKNIKNSDPKKIFIEMARSKEDKPTRKMSRKSRLEKLYTDSKKQFIKLFGPDEYDKLNNEIKNKSESDFRWDNLYLYYTQFGRCMYSLDPIDLEELSNKNLYDQDHIYPKSKIYDDSIENRVLVKKQLNLDKSNEYPIPDRVLNKDKNKLLAFWKMLNEKELIGDKKYARLIRKSPFTDEELGDFIARQLVETRQATKETANMLKRLCPDSKIVYVKAKNVSDFRRKFDILKCRSINDLHHAHDAYLNIVVGNVFDTKFTSNPLNFIKNNSKNRSYNLEKIYDYDVIRNEKIAWLAERKEENQDGSIATVLKNLSKNDIRVTRRTYIKCEDLFDENIVRKGNGKFPIKENNNKSDTNKYGGYSGIKNAYFVLLEDEKHNRILEAIPSFIYKKEKNGEKGSVINYLQNILGIKSAKILRDKIKIGSLLKIDKFPYNLAGKSGNGILISGGVQLILDKNTSKYIKKIENYKYKLDENKDYQINIFDKLSKEENIKLFDLFVDKFENSIYKNRVNIKLKEIKLARPKFEHLSIEEQIKTLTQMLILFGRENNAVNLEYIGLPKNTGKTKINKKINNKDIKIINQSITGLYETEEDLANI

SEQ ID NO: 65 - protein, 1552 aa, Anaerophaga sp.
  Anaerophaga sp. HS1
MFSQRNNPYCELLQNVKQLYKEKFGKTNQVDNSIIYGFMKRILGLDLGTNSIGWALVENDENDRKGKIIGMGSRIIPMDMSELDNFNKGASISKTAERTRLRMTRRLRERHLLRRARLHRILNIMGFLPEHYRNSIDFIDKKGCFFEGQEPKIAYKPDKNSEQFCFLFTSSFHEMLEDFRKFQPELIQNRKKVPYDWTIYYLRKKALTQKISKEELAWIILNFNTKRGYYHLRGEDEDNQDNKKIKEFRALKVVNVTEREGANSSGKKWYDMELENGWVYSRQSNLPPNLEGKTIELIVSYTLDNNGNIKKDKNGKEKYSLSMPGEEDWNLVKIKTENDLKTSKKSVGEYIYDHLLKNPDQKIRGKLISTIERKFYKEELSRILKTQMNFYEELKNRELYQKCVEELYPNNKSHQQTLLQKDFIHLIVEDIIFYQRPLKSKRAFVNNCPLEYRVYVDKKSGELIKSGVKCIPKSHPLFQEFRLWQYVRNLRIYERERMVNGRLMVNVDVTNELLPDEEHIVRLFDLLNDRKSFKQDDVLRFVGIKSPKDRKRYSWNYPEDKELPGNETRHLILAWLKKVDGVPEDWLDPEKLKALWHLLYSVTDREEIIKGLHSFAKKYELPDTFVEHFKKIPRLEREYGSFSEKAIKKLLPLMRMGKYWKAEEIPADLLEKAQKIIDAEADDRISDEVREKLLHLKDISQLKGLPLWQASYLVYGRHSETGEVVKWRTSEDLEKYILQFKQHSLRNPVVEQVILEALRVVKDIWEHYGEGKEGFFNEIHVEIGRELKNPADKRKKITSQIQENENTNLRIKALLEELFNDPSVKNVRPYSPAQQEILRIYEDGVLNGQKEIPDDILKISKMARPSKSQLVKYKLWLEQKYRSPYTGEIIPLSQLFTSAYEIEHIIPQARYFDDSFSNKVICEAEVNREKGHQLAFEFITKRGGDEIELNFGKKVTILNVEEYQKFVKDHYGRSLRSLSKMRKLLMEDIPDDFIDRQLNDSRYISKVVRNLLSNIVRAEDENSLVSKHLITCTGGVTTRLKHEWGLNDVWNELITPRFVRLNKMGKEKFGEWINKKGKQVFQIQMPLELQKGFNKKRIDHRHHALDALVVACASRSHVNYLNNDSARANASETRYDLRNKLCYKDKTDSNGNYRWKFYKPWESFTEEAKNRLAGTVVSFKSNRRIMTRSSNRYFKWVDTSEGKKKKLVRQIKGDNQAIRKPLHKDTVLGKVSLRKEKKVSLSKAIDLWESIVDKPLKKRIQSLREQGYDKKLLLKYFKDRNNQFNGQDISRVNIYFFDNNLAARRVTLDASFNSEKRIDGITDSGIKKILYAHLQNEKYHGKKDEKGNEISPYELAFSPEGLEEMNANIKKLNGGKPHCPIYKVRLAETIGEKFKLGEKGNKNKKYVEAAKGTNLFFAVYVDEKGVRSFETIPFSVALERRKQKLAVVPEENENKEKLLFYLSPNDLVYVPDEDEKLIDYRQLSINPTRIYKMVSSSGTQCFFIPHFVASPIVQTMELGPNNKSERAWDGQMIKNVCYKLSVDRLGNVKIEK

SEQ ID NO: 66 - protein, 1515 aa, Anaerophaga thermohalophila
  Anaerophaga thermohalophila DSM 12881
MKRILGLDLGTNSIGWALVESDEEQKSGKIQGIGSRIIPMDQNELDNFNKGNTVSQTAERTRLRMVRRLRERHLLRRERLHRVLKEIGFLPEHYLEQIDFTEKPGGFLPGKEPKIAYKPDNFKDKYDFLFQDSYHEMLSDFQDKNPEFIQKRKKVPQDWTIYYLRKKALTAKITKEELAWIILNFNQKRGYYQLRGEDEDVAKNTKKEEFHALKVVKVKEREDSEGASGKWYDIELENGWVYPRQSNIRPDWEGKILELIVTYNLDKDGNIKTDKEGNEKRSFRMPNKDDWTLRKKRTENEIEKSGKTVGEYIYDNLLDAPDLKIRGKLVSTIERKYYRSELEQILTAQKKYHPELSNSELFNKCISNLYPNNDIHRKALLSKDFVHLIINDIIFYQRPLKSKRSTVSNCPLEYRVYVDKVTGEKKKVPLKCIPKSHPLYQEFRLWQYVKNLRLFEKERFENGRLLTNVDVTEQFLPDEDKYVELFEFLNGRKTFKQDDILKFAGIKSAKDRVKYYWNYPQEKEYPGNETRYLIESRLKKIENVPDEWLNYEKIEELWHLLYSVTDKVEIEKGLQSFAAKYQLPDLFVEVFKGFPRMEREYGAFSKKAIKKLLPLMRMGKYWKLENINPDLIEKVQKIIDGEADDNINDGIRERFSEINEMSDLRGMPLWKASYLVYGRHSEAAEVIRWRTSADLDQYIKDFKQHALRNPIVEQVVLEALRVVKDVWNYFGEGREKFFDEIHVEIGRDLKNPADKRQKIANQIQENENTNLRIKALLVELFNDPEVQNVRPYSPVQQQLLKIYEDGVLNAERDIPDDIQKISRMANPTRNQLIRYKLWLEQKYRSPYTGEIIPLNKLFTSEYEVEHIIPRARYFDDSFSNKIISEAEVNRKKDRMLAFEFIKKLGGSTIDLNYGKKVSVLTVEEYQQFVKDHYGINPHSRLKMQKLLMDEIPESFIERQLNDSRYISKMVRNLLSNIVREENENSPVAKQLITCSGSITNTLKQEWGLNDVWNTIITPRFERLNKMGEQKYGEWVNKEGKPVFQIQMPLELQKGFNKKRIDHRHHALDALIVASATRSHVNYLSNEAAKTNAKDTRFDLRNRLCYKEKRGQNRNFTWRFYKPWNTFTEDAKNALNDIVVSFKSNHRVINKSTNRYFKWENLPGGMKKKRLVRQEKGDNWAIRQSLHKDTVLGKVSLRKVKPVSLSVALDSWNNIVDKALKKKIRSLKDQGYDKKLMLKYFKDRRNEYNGENISRVNVYYFDEEMAARRVDLDTSFNSEKRIEGITDSGIKKIIYAHLKNEKYHGQKDDKGKDISPYELAFSPEGIAEMNANIKQLNGGKPHCPIYKVRLAEPVGEKFQLGETGNKTEKLVEVAKGTNLFFGVYANDEGVRSFATVPFYLAVEREKQGLPAVPQENENGDQLLFWLSPNDLVYVPSEEDAHFANPKQIELDNSRIYKMVSSTGTQCFFIPHFVATPIVQTIELGPNNKSERAWDGQMIKKVCYKLSVDRLGNVEIE

SEQ ID NO: 67 - protein, 1168 aa, Azospirillum lipoferum
MARPAFRAPRREHVNGWTPDPHRISKPFFILVSWHLLSRVVIDSSSGCFPGTSRDHTDKFAEWECAVQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 68 - protein, 1068 aa, Bacillus cereus
  Bacillus cereus BAG4X12-1
MRYVLGLDIGIASCGWAVINQEKERIEDLGVRIFDKAENPKDGKSLAAPRRDARSTRRTLRRKKHRMQRIKILLVKQGLLFKTELNHLYESATEFDVWNLRLDALERKLHPKEFARVLIHLAKRRGFKSNRKETTLSENGQILESISENQQIMEQQNYRTVGEMILKDKKFENHKRNKDGTYIGTVTRQQLQDEIQMIFHTQRLYKNDYATEEFESSYLEIWASQRPYASKDQIEKMIGYCTLEPKEKRTPKASWSFQYFVALQTINNLRLISKDKIEELSFEEKKQIMNLALEKPIVKYIDIRKLLSIPNDFQFNSLSYSADTVDTTLENKRCIELKEYHSINKVYKQVYGKNTPNLLPIDYDTIAYGLTIFKDDKDILEYLQNKYVNAKGKPIKNLAKKTYDDTFIQALLNLNFTKMGHLSFKALKNIIPFLEEGLSYDKACEKAGYNFKGTSYTERTKYLPVIPQNTNPVVHRALSQTRKVINAIIKKYGSPNAIHIETARELSKTFQERKEIDSRYQDNSKKNEHAIHKLKELGNINPSGINIVKFKLWSEQDGRCMYSGKYIEPHRLFEEGYTEVDHILPYSRSLDDSYNNKILTLGTENQRKGNKTPYEYMGNTSIWDEFETRVQSNKKINFKKQQKLLLQNFSYAREQEFIERNLNDTRYATIYLTSLIQQHLIFSESSSKKKVRTVSGIITSHLRSRWGFNKDRKEGHIHHALDAVIVAVTSNHMIQRVTKYYKLKELNKNLQAKQLPFPEPWEGFRLELEARISPNTQQYLKGIHFKNYADVNLSDIKPIFVSRMPKRSITGELHQETIRKFLGYNEKGKVLTAIKTKLEDIPFDANGDFPMYGKETDLYTYNAIKERYLSHEKDKRKSFQEPLYKPTKSGEIGPLIKSIKIMDTRTIVNPVNQGKGVVYNSKIARTDVFKKEDKYYLIPIYTIDLLKNILPHKAITAGKGYEDWTTIDSSFTFLFSLFPNDLIQIVPSKNKTIKARTTVSKKEILLPSLTGYFKGVHSGTAGITVETHDGSVIANVGSKQLLLFEKYQVDVLGHYTKIKEEKRMGMAI

SEQ ID NO: 69 - protein, 1078 aa, Bacillus cereus
  Bacillus cereus BAG4X2-1
MRYVLGLDIGIASCGWAVINQEKERIEDLGVRIFDKAENPKDGKSLAAPRRDARSTRRTLRRKKHRMQRIKVLLVKHGLLSKTELDHLYESATEVDVWNLRLDALERKLYPKEFARILIHLAKRRGFKSNRKETTLSENGQILESISENQQIMEKQNYRTVGEMILKDKKFENHKRNKNGTYVGTVTRQQLQDEIQMIFHAQRLYKNDYATEEFESSYLEIWASQRPYASKDQIEKMIGYCTLEPKEKRAPKASWSFQYFVALQTINNLRLISKDRIEELSFEEKKQIMNLALEKSIVKYIDIRKLLSVPNEFQFNSLSYSADTVDTAVESRKCIELKEYHSINKVYKQIYGENALNLLPKYYDTIAYGLTIFKDDKDILEYLQNKYVNAKGKPISNFANKTYDDTFIQALLNLNFTKMGHLSFKALKNIIPFLEEGLSYDKACEKAGYNFKGTSYTEQTKYLPVIPQNTNPVVHRALSQTRKVINAIIKKYGSPNAIHIETARELSKTFQERKEIDSMYQDNSKKNEHAIHKLKELGNINPSGINIVKFKLWNEQDGRCMYSGKYIEPHRLFEEGYTEVDHILPYSRSLDDSYNNKTLTLGTENQRKGNKIPYEYMGNTSIWNDFETRVQSNKKINKKKQQKLLLQHFSYAREQEFIERNLNDTRYATIYLSSLIQQHLIFSESSRKKKVHTVSGIITSHLRSRWGFNKDRKEGHIHHALDAVIVAVTSDHMIQRVTKYYKLKELNRNLQAKRMPFPEPWEGFRLELEARISPNTQQYLKGLRFKNYADVNLSEIKSIFVSRMPKHSITGELHQETIRKFIGYNEKGKVLTAIKTKLEDIPFDANGDFPMYGKESDLYTYNAIKERYLSHKKDKRKSFQEPLYKPTKSGGIGPLIKSIKIMDTRTIVNPVNQGKGVVYNSKIARTDVFKKEEKYYLIPIYTIDLMKNILPQKAITAGKGYEDWTTIDPSFTFLFSLFPNDLIQIVPSKNKTIKARTTVSKKEVLLPSLTGYFKGVHSGTAGITVETHDGSVIANVGSKQLLLIEKYQVDVLGNYTKIKEEKRIGLTTYNDNKKIAAC

SEQ ID NO: 70 - protein, 1069 aa, Bacillus cereus
  Bacillus cereus Rock1-15
MNYDIGLRIGITSCGWSIINKDLERIEDLGVRVFEKAENPDGTASAAPRREARKSRRKHRRKKHRIERIKRLIVQHDLLSKKELDSLYLSPFNIDVWNLQVEALERKLDNREFARVLIHLVQRRGFQTIRKSVEIQEEGKLLENVSENERIMKVNGYKTVGEMFSKHEKFTHHKRNKDGSYTSVVTRSLLLKEIKTIFNSQRILGNVFSTQKLESDYLYIWGSQRPTLTYEQLMSMVGNCIYEKKEKRAPKTSWAFQYFSLLQKINKLKVSDDNTLRKLSKEERDIVIELAFKKKNVSFVDIRKALKLNDNTKFNHLTYSHVVETKKVEKATFIELKGYHLIKKQLKDRNVELTQELQPKDYDAIAAASTFFKNDIEFRDYLRNQYLDSNGKRKSNIANKVFEDKVIAAVFELNFSKVCHLSFKSLYKLIPHLEKGLDYKEAILCAGYNFRDENKRDKKLFLPVIQQETNPVVHRALTQARKVINAIIREYGSPNTIRFVVANDLAKTYKQRKELESTLKKNRAENEKIKTKLLSMGIINPTGMDIVKYKLWYEQSGICLYTGRQMELSSLFKPGYSIVNHIIPYNRSFDDTYHNRVLTLTETKYEKGNKIPFEYFGAEETCWNEYEKRVSTSKKIHDKKREKLLIRNFDIEYENEMISNNVFDTHYIGSYFEKYIDEHLQFKKSTKKQKVFSIHGNMVAHLHSRWGFNKNSREIYLNHAVDAAIVAVLTDQLIRNIADYYRRDNILEQKGSLKFPEPWKSFSIELEARISPQVRDLIKKLNLDSYLDVDILHIKPVFISKKPRRKVNGEAHKSTIRSLIGINEIGKTVTCIKTRLEDIPFDENGDFPMYGKDTDKYTYTAIKERYLEFNKDKEKAFSTPLYKLKRNGEPGNQIKSVKIIDTRNIVNKVNQGKGIAYNSNIIRVDVFSRDQKYYVVPIYLRDFIKGSLPNKIITAAKGFMQWPETDNSYTFLFSIFPNDLIKVVPKEGKFIKAKNENKENINLTEILGYFKGLDSSTGAFTLESHDGSLLARGIGTKNLLLIEKYQVDVLGRYNKVGNEERQDIKIQQN

SEQ ID NO: 71 - protein, 1088 aa, Bacillus smithii
  Bacillus smithii 7_3_47FAA
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 72 - protein, 1069 aa, Bacillus thuringiensis
MNYDIGLRIGITSCGWSIINKDLERIEDLGVRVFEKAENPDGTASAAPRREARKSRRKHRRKKHRIERIKRLIVQHDLLSKKELDSLYLSPFNIDVWNLRVEALERKLDNREFARVLIHLVQRRGFQTIRKSVEIQEEGKLLENVSENERIMKVNGYKTVGEMFSKHEKFTHHKRNKDGSYTSVVTRSLLLKEIKTIFNSQRILGNVFSTQKLESDYLYIWGSQRPTLTYEQLMSMVGNCIYEKKEKRAPKTSWAFQYFSLLQKINKLKVSDDNTLRKLSKEERDIVIELAFKKKNVSFVDIRKALKLNDNTKFNHLTYSHVVETKKVEKATFIELKGYHLIKKQLKDRNVELTQELQPKDYDAIAAASTFFKNDIEFRDYLRNQYLDSNGKRKSNIANKVFEDKVIAAVFELNFSKVCHLSFKSLYKLIPHLEKGLDYKEAILCAGYNFRDENKRDKKLFLPVIQQETNPVVHRALTQARKVINAIIREYGSPNTIRFVVANDLAKTYKQRKELESTLKKNRAENEKIKTKLLSMGIINPTGMDIVKYKLWYEQSGICLYTGRQMELSSLFKPGYSIVNHIIPYNRSFDDTYHNRVLTLTETKYEKGNKIPFEYFGAEETCWNEYEKRVSTSKKIHDKKREKLLIRNFDIEYENEMISNNVFDTHYIGSYFEKYIDEHLQFKKSTKKQKVFSIHGNMVAHLHSRWGFNKNSREIYLNHAVDAAIVAVLTDQLIRNIADYYRRDNILEQKGSLKFPEPWKSFSIELEARISPQVRDLIKKLNLDSYLDVDILHIKPVFISKKPRRKVNGEAHKSTIRSLIGINEIGKTVTCIKTRLEDIPFDENGDFPMYGKDTDKYTYTAIKERYLEFNKDKEKAFSTPLYKLKRNGEPGNQIKSVKIIDTRNIVNKVNQGKGIAYNSNIIRVDVFSRDQKYYVVPIYLRDFIKGSLPNKIITAAKGFMQWPETDNSYTFLFSIFPNDLIKVVPKEGKFIKAKNENKENINLTEILGYFKGLDSSTGAFTLESHDGSLLARGIGTKNLLLIEKYQVDVLGRYNKVGNEERQDIKIQQN

SEQ ID NO: 73 - protein, 1509 aa, Bacteroides coprophilus
  Bacteroides coprophilus DSM 18228
MKKTLGLDLGTNSIGWAVINSNIDSEGKEKLVGISSCGSRIIPMDATTLGDFGKGNTKSPVAERTRLRGIRRLLERSLLRRERLHRVLSVMGFLPEHYASQLDRYGKFLPETEPKLAWYKDDSGRYQFLFQKSFHEMLEDFRQHQPELVAGEKKIPYDWTIYYLRKKALSQEITKEELAWILLNFNQKRGYYQLRGEEEQEENNKSVEYHALKVVSVEDSGERKGKDIWYNVTLENGWVYRRASNIPLDWTGKVKEFVVTTELDDAGNPKKDKEGNVKRSFRAPKEDDWGLLKTRTQAQIDESGKTVGTYIYESLLCMPNQKIRGKLVRTIERKYYKDELRQILVKQSEFHAALQDHNLLLSCIEELYPNNEAHRRLLSASSFIYFLIEDILFYQRPLKSQKGLIDNCPYESHIYKDKKDGSLHHVPLKCVSKSHPLFQEFRLWQFLSNLRIYQRERMMDGSLKLDVDVTREFLPSEEDYVKLFDWLNERKEISQKFLLAYKPFGLKKNEQANYRWNYVEDKSYPCNETRAEIKSRLSKAGVPEEFLTEEKEEALWHILYSISDKKELTKALGTFAAKNCLNESFVEVFAKIPPFESNYAAYSLKAIRKLLALMRMGKYWNEQAIDRQTRDRIEKILTGEYDETIRSRVREKAMLLTDISSFRGLPLWLACYIVYDRHSESKELVKWETPADIDHFLSKFKQNSLRNPIVEQVITESLRTVRDIWKQEGKIDEIHVELGREMKNPAKERARITAQVQENENTNLRIKALLAEFMNPEFEIENVHPYSPGQQEILRIYEDGVLSGIAEKDLPDDITAILKKFRENDVKKRPTTSEVLRYKLWLEQRYRSPYTGRVIPLGKLFTPAYEIEHVIPQSRYFDDSISNKVICESAVNKLKDNCLGYEFIKKHSGEMVELGNGETVPVFSVEEYERFVKESYFGNSKKMKKLLLEDIPDSFIERQLNDSRYISRVVTSLLSNLVCEEGEQDGLSKNVIVCTGGITDRLKKDWGVQEVWNRIILPRFLRLNEITGRTDFTSTSVNGHLLPALPLYLQKGFNKKRIDHRHHAMDAIVIACANRNIVNYLNNSSARKNSEISRYDLQRLLCEKVKTDANGNYKWILRKPWETFTQDVYAALTNIVVSFKQNLRVINRTTNYYQHYNEAGEKRMIPQTKGDRWAIRKPMHKDTVYGEVNLRKEKTLPLRDVVKNPSIVVDKSLKNKLYELLKSQYDLKAIAKYFETHQDVWADVNLKKIKVYYFTKETNERFFATRKSLDPSFDQKKIEEEVTDTGVQKILLHHLQQNNNDPDMAFSPDGIDRMNQNMTILNDGKWHQPIYKVRTYEKADKFAVGESGNKAKKFVEAAKGTNLFFAVYESVQEDEAIGKQVCKRTFATIPLNEVIKRKKQGLPAAPEDLNGNLPKFVLSPNDLVYLPTEEERNSSRIIQPLDRERIYKMVSSSGSQCFFIKVFVANSIWDKNEYSSLNKMERAITNEMIKEICVPIKIDRLGNVSLIQI

SEQ ID NO: 74 - protein, 1504 aa, Bacteroides coprosuis
  Bacteroides coprosuis DSM 18011
MKKVLGLDIGTNSVGWAVVNQNDKGEFLSIEKIGSRIIPMSQDVMDKFGAGQTESSTAQRTQYRGVRRLRERSLLRRERLHRVLHILHFLPQHYDAAIGWNKKENKTYGKFLPGVEVNIPWVATDQGHQFIFMDSYAEMLKDLKQHQPHLFEKSSTPVPLDWTIYYLRKKALTQAISKEELAWILLNFNQKRGYYQLRGEEVEDNTKREEFYALKVVKVELDKDNTSAKTWYKVHLENGFIYPCPSDTPIDSWVGMVKDFIVTTTLEKDGSEKRTADGEIKRSFRAPKEDDWTLLKKKTESELEKSGKQVGAFIYDTLLSNPDQKIIGGLIKTIERKYYKKELEQILETQQKFIAELSDKKLFQACAEELYPLNDSHRENLLERDFKHLFVQDIIFYHRPLKTKKSLISNCTYEYRTFYKNGEKQISPIKCIAKSNPLFQEFRVWQFVQNLRILQRQRSEGDSIKYNVDVTAEFLKDENDIANLFTWLNERKVIKQDQLLKSYFKLKVNKETKELDYRWNYVDDKNKEYPCNATRTHILSFLEKCKEEKRIEDDRFVYSLWHLLYSVVEPIELRGALAKFAEREHLHPSFVDVFAQFPPLEKEYGSYSEKAIKRLLPLMRMGDYWHEDKIDVKTKQRIQRIIDGEADDDITHRSREKVENLRSITDFKGLPLWKAGYVVYNRHSESGELTKWKTPHELSNYIQNEFKQYSLRNPIVEQIVLETLRVVHDLWVKHGDFSEIHLELGRDIKNSSDKRKRMAERQQENENSRQRVLEMLIDLKKEAAFADLNPYSPSQQEKLRIVEDGVLRSNIEIPKDIEKITKSAKPTSRELTKYRLWLDQKYRSPYTGQPISLAQLFTSKYEIEHVIPQAKYFDDSFTNKVICESEVNKEKGSMLAHEFILKNGGSTVNVGGRQVQVLKNDAYVELINRLYGKNNPVKAKKLLAEDIDEVVGDFSERQLNDTRYISRVVQKLLSNIVREEDEQESTSKHVIGCSGQVTTALKKDWGLNDIWNKIIQPRFERLNEMTATEDYGVWQSPNHFQIRVPEEIQKGFTKKRIDHRHHAMDALVIACATRSHINYISNRSGQDRNAKFETTRTDLRSKLCYKENSSGNNYNYIFNKPWDTFTQDAHRALENIVVSHKQNLRVLTKTNNYTQFINKDGKKDLQKQVKGDHFAVRKPMHQETIYGRVSIRSIKEVALKKALENWKQIVDRTLKDKIRELIGAYGKYDAQTILKYFKDRDYKFNNLKINRVEVYEYDHNCAAVRKSIGDDLTIKQIERITDESIRKILMNHLSNYDDNLKEAFSPEGLMEMNKNIKELNGGKNHQPIYKVRLFEDLGSKFPLGVSHNNPDKYAIAAKGTNLFFGIYEDQEGKRMFDSIPLNIVIDRLKEKKSPVPETYNESKLKFHLSPNDLVYVPTDEEQKQPELVDVDHLSDEQKGRVYKAVSFTGNRAFFVNHRVSKVIHDYVEFGTKNKIENDDDKRSLKHICWKLKVNRLGEITDVKR

SEQ ID NO: 75 - protein, 1504 aa, Bacteroides dorei
  Bacteroides dorei DSM 17855
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNYPNLITDDKKVPYDWTIYYLRKKGLTSKISKEELAWILLNFNQKRGYYQLRGEEEEENKDKLVEFYALKVVAVEDSGEKKGKDIWYNVHLENGWVYRRTSNMSLDWVGKTKEFIVTTDLEKDGTPKKDKEGNVKRSFRAPKEDDWSLVKKKTEADIDQTHKTVGAYIYDTLLGNPSQKIRGRLVRTIERKYYKEELKLILEKQKEFHLELQDRALYAACIEELYPINEAHRNNVGNRDFTYLFLEDILFYQRPLKSKKSLIDNCPYEENQGLDKETGEIKSFPVKCIAKSHPLFQEFRLWQFIINLRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEIIQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEVLRYKLWLEQKYRSPYTGEVIPLGKLFTPAYEIEHVIPQSYYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNKSATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKSSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSSSGEQCFFIKHIVANVLVDKFEFSPLNKMERALTGEMIKMICIPIKVDRLGNVLESSSSYKK

SEQ ID NO: 76 - protein, 1509 aa, Bacteroides eggerthii
  Bacteroides eggerthii 1_2_48FAA
MKTILGLDLGTNSVGWAVINSVIKEQAERIWIEMAGSRIIPMDAAVLGDFDKGNSISQTSERTRLRGARRLRERQLLRRERLHKVLNILGFLPNHYLEYIDFEKHPGKFLADAEPKLAWVKDEQGKYTFLFQAAFDEMLADFAIHQPSLVSGDKKIPYDWTIYYLRKKALTEMISKEELAWILLNFNQKRGYYQLRGEEEEDNAGKSVEFYALKVLTVEATDEKKGRDVWYNVHLENGWIYRRSSSVPLDWEGQVKEFIVTTDLNPDGTPKLDKYGEVKRSFRAPKEDDWMLIKKRTEADIANTHKTVGAYIYDTLLQKPQQKIIGKLVKTVERKLYRDELSLILQKQCAFHAELQDRALYARCVEALYPSNEVRRKNIANRDFVYLLMDDILFYQRPLKTKKSLIANCPYEENEYVDRETGEIKKTPLKCIAKSHPLFQEFRLWNFLSNIRIYQKEKEINGTLHLDVDVTAEFLKTEDDYVALFDWLNSRKEIEQKTFLKYPKFGLKKEISNYRWNYVEDKQYPCNETRHAILSSLEKANVCIDFLSNEKEVALWHILYSVSDKQEIEKALRTFAAKNGLDESFVEAFKKFPPFKSEYGAYSAKAIKKMLPLMRCGKYWDVSSIDDTTKERIKKIVTGEYDERISVKVRDKVMNLSDISCFRRLPLWLACYIVYNRHSEDKEAVKWESPADIDAYLASFKQHSLRNPIVEQVITETLRVVRDIWKQVGRIDEIHIELGREMKNPADKRKRMTAQILENENANLRIKALLAEFMNPEYEIENVRPYSPSQQEILRIYEDTVLHAEDQLPEEIDAILKKFNSSKVPTKSEFLRYKLWLEQKYRSPYTGELIPLGKLFTAAYEIEHVIPQSRYFDDSFSNKVICESAVNKLKDNQLGYEFIKNHHGQKVEVGFGKSVEIFSVDSYERFVKEQYAKSAVKMKKLLMDDIPEQFIERQLNDSRYISKVIKGLLSNIVREKNDSGEYEPEAVSKNIVVCTGSVTDRLKRDWGMNDVWNSIVYPRFERLNSLTDTQSFGHWENKSGKKVFQTELPLEYQKGFSKKRIDHRHHAMDAIVIACATRNHVNYLSNESASRNAKISRYDLQRLLCDKNRTDDNGNYKWVIKKPWDTFTQDAREVLSKIVVSLKQNLRIINKTTNVYRHLDATGNRVYEKQKTGDSWAIRKPMHKDTVFGAVNLRKVKVVRLSVALDTPAMIVDKRVKNKVFELLSYKYDKKRIEKYFKENAFLWKELDLAKVAVYYFTEATTEPLVAVRKPLDSTFNEKKIKESVTDTGIQKILLNHLCTKEGKPDLAFSAEGIEEMNRNLLQLNNGKSHQPIYKVRVYEPRGNKFSVGVLGNKGTKWVEAAKGTNLFFAIYITEDGKRTYETIPLNVVIEREKQGLVPVPDRNKKGDKLLFWLSPNDLVYLPTEEEREFGRINEPIDRGRIYKMVSCTGNEGHFIPANVANPIVPVIELGSNNKAQRAWTNEMIKDICIPIKVDRLGHIIEVKYRIDE

SEQ ID NO: 77 - protein, 1526 aa, Bacteroides faecis
  Bacteroides faecis MAJ27
MKKILGLDLGTNSIGWAVLNAADDNSLKYIEAAGSRIIPMDAAILGDFDRGNSISQTAERTRIRGMRHLRERYLLRRARLHRILNLLGFLPFHYAQDIDRYGNFSADMEPKIAWCKNLEGELEFIFIESFNEMLEDFRKNQPELVADNKKVPYDWVIYYLRKKALEKKISKEELAWILLNFNQKRGYYQLRGEDDDESMKTAKTRQYFDKQIIKNIIDTNQTYKGQRILIVELQNGDKGKIFKKEIPDWIGQEKNIIVTVDIDKDGNDKYEESGSLSCRFKIPTDAEWESEWKLIKMKTQKDLDESNKTVGTYIYDSILQNPTQKVRGKLVRTIERKYYKAELKQILEKQTEFHSELQDKDLYIECLNELYSNNDTHRNAITDRDFVYLFMNDILFYQRPLKSKKSLIDNCPYERNIYIDKETGEIKYSPIKCIAKSHPLFQEFRLWKFISSIRIYQRESVVEVVDKQLDLFSSQSTSVQKLVTDVDVTDKFLTCENDYVALFEWLNKKKIIDQKEFLKYRPFGLKGDIDNYRWNYVEDKSYPCNETHAMILTYFAKAGISEDILTKEMEEALWHILYSVEDRQEITKALRTFASKYHLSDSFVKVFSNIPPFKKEYGSYSAKAIKKLLSLMRMGKYWSEDAIDVNTRERIDKIVTGEYDEKIRDRVREKTIRLNDIRHFRALPDWLACYVVYDRHSETREITEWKSPEEIDEYIRNFKQHSLRNPIVEQVITETLRTVRDIWKQVGCIDEIHVELGREMKNPADKRKRITSQIIENENANLRVKALLTEFVNSEFEIENVRPYSLSQQDILRIYEDGVLNSVAEVPGDIAGILKKFNENDAKKRPTTSEILRYKLWLEQKYRSPYTGEMIPLSKLFTSAYEIEHVIPQSRYFDDSFSNKVICEAEVNKLKDNALGYEFIKKHHGEKVELGFGKIVEIFSVSVYEQFVKDNYSRNRGKMKKLLMDEIPEQFIERQLNDSRYISKVVKTLLSNVVREKAEQEAVSKNVIVCTGGVTDRLKKDWGINDVWNKIVLPRFLRLNELTNSTNFTAKNAAGNEIPAMPLELQKGFNKKRIDHRHHAMDAIVIACANRNIVNYLNNESASRKAKISRHDLQAILCDKVRTDDKGNYQWRVKKPWDTFTQDVYVALENIIVSFKQNLRVINKTSNYYWHYENGKKVLVKQVKGDSWAIRKPMHKDTVFGEVNLRKVKSVSLNEALKNPQFIVEKDLKRQLLSLLQQNFDIKKIKKYFEEHKDIWSDISLSKMNIYYFTKETKDRYFATRKPLDASFDKKKIESCITDTGIQQILLRHLELKENDPERAFSPDGIDEMNRNIIQLNKGKGHHPIAKVRVYEKADKFEVGQRGNKSSKFVEAAKGTNLFFAVYETEYPDEKTNSIVRKRNYATIPLNIAIERQKRGLSTAPEDEKGNVPSFVLSPNDLVYLPTSEDIVNGHITQPIDKSRIYKMVSSSGSQCFFIKHNIANIIVDKYEFSPLNKMERAISNEMIKEICIPVKVDRLGNIVKLGKSE

SEQ ID NO: 78 - protein, 1509 aa, Bacteroides fluxus
  Bacteroides fluxus YIT 12057
MKTILGLDLGTNSVGWAVINSVIKEQAERIWIEMAGSRIIPMDAAVLGDFDKGNSISQTSERTRLRGVRRLRERQLLRRERLHKVLNILGFLPNHYLEYIDFEKHPGKFLSDAEPKLPWVKDEQGKYTFLFQAAFDEMLADFAIHQPSLVSGDKKIPYDWTIYYLRKKALTEMISKEELAWILLNFNQKRGYYQLRGEEEEDNAGKSVEFYALKVLTVEATDEKKGRDVWYNVHLENGWIYRRSSSVPLDWEGQIKEFIVTTDLNPDSTPKLDKYGEVKRSFRAPKEDDWMLIKKRTEADIANTHKTVGAYIYDTLLQKPQQKIIGKLVKTVERKLYRDELSLILQKQCAFHAELQDRTLYARCVEALYPNNEVQRRNIANRDFVYLLMDDVLFYQRPLKTKKSLIANCPYEENEYVDRETGEIKKAPLKCIAKSHPLFQEFRLWNFLSNIRIYQKEKEINGTLHLDVDVTAEFLKTEDDYVALFDWLNSRKEIEQKTFLKYPKFGLKKEISNYRWNYVEDKQYPCNETRHAILSRLEKANVCIDFLSNEKEVALWHILYSVSDKQEIEKALRTFAAKNGLDESFVEAFKKFPPFKSEYGAYSAKAIKKLLPLMRCGKYWDVSSIDDTTKERIKKIVAGEYDERIAVKVRDKVMNLSDISCFKRLPLWLACYIVYNRHSEDKEAVKWESPADIDAYLASFKQHSLRNPIVEQVITETLRVVRDIWKQVGRIDEIHIELGREMKNPADKRKRMTAQILENENANLRIKALLAEFMNPEYEIENVRPYSPSQQEILRIYEDMVLHAEDQLPEEIDAILKKFNSSKVPTKSEFLRYKLWLEQKYRSPYTGELIPLGKLFTAAYEIEHVIPQSRYFDDSFSNKVICESAVNKLKDNQLGYEFIKNHHGQKVEVGFGKSVEIFSVDSYERFVKEQYAKSAVKMKKMLMDDIPEQFIERQLNDSRYISKVIKGLLSNIVREKNDSGEYEPEAVSKNIVVCTGSVTDRLKRDWGMNDVWNSIVYPRFERLNSLTDTQSFGHWENKSGKKVFQTELPLEYQKGFSKKRIDHRHHAMDAIVIACATRNHVNYLSNESASRNAKISRYDLQRLLCDKSRTDDNGNYKWVIKKPWDTFTQDAREVLSKIVVSLKQNLRIINKTTNVYRHLDATGNRVYEKQKTGDSWAIRKPMHKDTVFGAVNLRKVKVVRLSVALDAPTMIVDKRVKNKVFELLSYKYDKKRIEKYFKENAVLWKELDLARVAVYYFTEATTEPLVAVRKPLDSTFNEKKIKESVTDTGIQKILLNHLCTKEGKPDLAFSAEGIEEMNRNLLQLNNGKRHQPIYKVRVYEPRGNKFSVGVLGNKGTKWVEAAKGTNLFFAIYITEDGKRTYETIPLNMVIEREKQGLAPVPDKNEKGDKLLFWLSPNDLVYLPTEEELEFGRINEPIDRGRIYKMVSSSGNQCFFIPQSISNAIIPTKELGANNKAERSWDGAMIKNICIPVKVDRLGRIIEVKYRINE

SEQ ID NO: 79 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQSYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKLAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDENPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGQPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 80 - protein, 1436 aa, Bacteroides sp.
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 81 - protein, 1512 aa, Bacteroides nordii
  Bacteroides nordii CL02T12C05
MKNILGLDLGTNSIGWAVINSEEDGPIVKKRIELAGSRIIPMDAAVLGNFDSGVTKSQTAERTSFRSIRRLRERQLLRRERLHKVLQILGFLPEHYVNDIDFENHPGKIKRNTEPKLPWRKNSMGQFEFIFQDSFEAMLTDFATHQPVFVSEGKKVPYDWTLYYLRKKALTEGISKEELAWLILNFNQKRGYYQLRGEEEEEQSNKLVEFYALRVVKVEATDDKKGKDTWYNVHLENGWIYRRTSNIPLDWEGKVKEFIVTTDLNEDGTPKLDKYGEVKRSFRAPKEDDWTLIKKKTESDIANSHKTVGCYIYDALLQNPHQKIKGRLVRTVERKFYKEELRLILEKQLSFHPELQDRDLYRACIDALYVSNEAHKNNISGRDFVYLFIDDIIFYQRPLKTKKSLIDNCPYEENQYMDRETGEVKQAPIKCIAKSHPLFQEFRLWQFISNIRIYQRERVLDDGKLETDVDVTPDFLKTEDDYTTLFEWFNDRKEVDQKAFLKNPQFGLKKTFTEYRWNYVEDKSYPCNETRNAILNGLQKAGVSADFLSREVEEALWHILYSVEDKIEIESALRKFASKHDLDDRFADVFKKLPPFKKEYGAYSAKAIKKLLPLMRIGKYWELSNIDDKTKERIDKIITGEWDENIHDRVREKAIKLSDITDFKGLPLWLSCYVVYNRHSEARAIAKWESPEDIDSYLRLFRQHSLRNPIVEQVITETLRTVRDIWKRVGQIDEIHVELGREIKNPADKRAKMTAQIVENENTNLRIKALLAEFINSEYEIENVRPYSSNQQEKLKIYEDTVLNGVKEIPEDINTILKKFRESDLKKRPTKSDFLHYKLWLEQKYCSPYTGRIIPLGKLFTSAYEIEHIIPQAHYFDDSFSNKVICEAEVNGLKDKKLGYEFIKHNPGKMVEIGFGKPPVRIFSVEEYERFVKENYSGIKNKMNKLLMDDIPETFIERQLNDSRYISKVVKSLLSNIVREKDSNGEYEPEAISKNVIVCTGSVTDRLKRDWGVNDVWNSIIYPRFERLNELTGSQQFGCWENKEGKRVFQTAVPLEMQKGFSKKRIDHRHHAMDAIVIACATRNHINYLSNESASKKAKISRTDLQRLLCTKCRTDDNGNYKWIVKKPWPAFTQDIRKALENITVSFKQNLRVINKTTNYYVHFDESGKKVLEKQINGDSWAIRKPMHKDTVFGKVNLQKVKEVRLSLALDTPKMIVDKKLKEKVLQLYSYKYDKKRIDKYFKENASLWKDLNLSKVAVYYFTNDSTEPLVAVRKPLDTSFNAKKIKESVTDTGIQKILLNHLSNNQDDPNLAFSPDGIDKMNKNLTALNDGKYHQPIYKVRVCEPQGNKFSVGTSGNKTSKYVEAAKGTNLFFAVYQTEDGKRSYETIPLNVVIEREKLGWTPVPENNNNGDKLLFWLSPNDLVYVPTADELNNGMRLDNMDKGRIYKMISCSGPQCFFIPQNVSNAIIPVIELGANNKAEKSWNNEMIKVVCVPIRVDRLGCITQINNQK

SEQ ID NO: 82 - protein, 1436 aa, Bacteroides sp.
  Bacteroides sp. 2_1_16
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKETYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSAIFEELNDAEQLELNGSRRLCQEEKELLAQELFVRDKMTKSEVLKLLFDNPQELDLNFKTIDGNKTGYALFQAYSKMIEMSGHEPVDFKKPVEKVVEYIKAVFDLLNWNTDILGFNSNEELDNQSYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKANEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIETVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKIGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 83 - protein, 1517 aa, Bacteroides sp.
  Bacteroides sp. 20_3
MKKIVGLDLGTNSIGWALINAYINKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICFPIKVDRLGNIIQVGSCILTN

SEQ ID NO: 84 - protein, 1424 aa, Bacteroides sp.
  Bacteroides sp. 3_1_19
MKRILGLDLGTNSIGWALVNEAETDEEVSSIIRLGVRVNPLTVDETQNFEKGKSITTNAERTLKRSMRRNLQRYKLRRDALVEFLKELGFITDETILSEQGNRTTFETCRLRAKAAEEEISLEELSRVLLMINKKRGYKSSRKVKKEEDGVLIDGMEIAKKLYEEDLTPGQLCSQLLESGKKVLPDFYHSDLQEELDRIWSVQKQFHPDVFCDAAKEEIKGKNRSQTWAILANYFVWKEEVVGWNDREAKNETIEKECKLVGLKRTTKGYELKKENYRWRAQALTEQLGLEEIAVVLQEINGQINASSGYLGAISDRSKVLYFNHQTVGQYQMAELDKNPHASLRNMVFYRQDYLDEFDRIWEKQAEFHKELTAELKKEIRDMIIFYQRRLKSQKGLISFCEFERLEIVVEKDGKKQTKVIGCKVIPRSHPLFQEFKVWQTLNDIKVLGREKKRNALSASESRALYPEEKEILARELAIKENMKKADVLKLLFENPQELDLNFKQIDGNRTGFSLFSAYSKMIEKYGYEPLDFKKPADEIIGQLRTIFTDLGWNTNLFTIDLTKEGKELEMQPYFRLWHLLYSFEGDNTSTGNGKLIEKIMQLCGVEKEYAVELASLSFQDDYGSLSAKAIKRILPYLKEGNLYDVACEYAGYRHSKSSLTKEEIENKVLKGKLEVLPKNSLRNPVVEKILSQMVNVINTIIDTYGKPDEIRVELARELKKSAKEREELTKAIAKSTREHEEIRKLLQDEFGMMNVSRNDIIRYKLYEELKDNGYKTLYSNQYIPKEKIFSKEIDIEHIIPQSRLFDDSLSNKTLEYKAINIEKGNKTAYDFVKEKYGEEGLQQYINRCESLFNDKKAKLRKLKMEQKDIPDGFIDRDLRNTQYIAKKALAMLNEICRRVVATTGSITDQLREDWQLVDVMKELNLPKYEALGFVETYEDKDGRKIKRIKDWTKRNDHRHHAMDALTVAFTKDAFIQYFNNKNAAQDSGNRNHTNIIGIKTRYFDKGRALPPIPLEQFRIEAKQHLEKLLVSIKAKNKVVTVNVNRTKKRKGENTKIQQTPRGQLHLETVYGSHKQYVTKIEKVNASFDAAKIATVSKRAYRNALLKRLETFGNDPKKAFTGKNALEKNPLYADKYQTIRVPEKVQTVEFETIYTIRKPVDPALNVDKVVDVKVRAILERRLKEYGGDPKKAFVNFWENPIWLNKEKGISIKRVSIRGINNAQSIHVKKDKNGNPIWDENGKQIPVDFVNTGNNHHVAIYRKPVLDKKGQVTFDEDGNLMYELDEVVVPFFEAVTRANLGLPIIDKDYRKSEGWQFLFSMKQNEYFVFPNEKTGFNPKEVDLLNPDNYAMISPNLFRVQTMSKVMYGNNVVRDYKFRHHLETTVKDMKELKDIAYKQYKTLSFGNSVVKIRINHIGQIVSVGEY

SEQ ID NO: 85 - protein, 1510 aa, Bacteroides sp.
  Bacteroides sp. D2
MKRILGLDLGTNSIGWALVDSEEQRILGMGSRIIPMDQGVLDTFSGGNPVETQTAARTAYRGTRRLRERALLRRERLIRVLNMMKFLPEHYASQIDFEKRLGQFFDEKEPKLAWKQNDEGRFEFIFQQSFNEMIEEFKNKGVVREDKKIPYDWTIYYLRKKALSQEIEKEELAWILLNFNQKRGYYQLRGEEEEENPNKLVEYYSLKIVDVIADEKPNSKGDIWYSLHLENGWIYRRSSKIPLFGWKDKTRDFIVTTDLNDDGTVKKDKEGIEKRSFRAPSENDWVLLKKKTESDIEKSHKTVGAYVYETLLQNPMQKVRGKLVRTIERKFYKDELKQILEKQREFHPELRDEDLYNDCVRELYRSNETYQFILSKRDFVHLFLDDILFYQRPLRSQKSAIGDCILEFKTYKDKDGNNIKEYLKVISKSNPLYQEFRIWQWLYNLKIYRKEDDEDVTLQFIANIEDKEQLFDFLSNRKSIEQKPLLEYLIKAKGLKKQVKTEAYRWNYVEDKIYPCSETKTMISTRLAKVENIPDNFFTKEIEQKLWHIIYSVTDKNEFEKALRTFAKKYDLDIASFVDNFKKIPPFKNEYGSFSEKAIKKLLPLMRLGKYWKWNDIDNNTQNRISKIITGEYDEEIKDIVREKSIALTNENDFQGLQLWLAQYLVYGRHSEADIAGKWHSVADLEKYLNEFKQHSLRNPIVEQIITETLRVVRDIWRKYGQGAENFFSEIHVELGRDMKNTADERKKIVNVVTENENTNLRIKALLMELKNNSDGKLEVENVRPYSPTQQDILKIYEEYAISTGLDNEKDEKVKEDIKKISRVAQPTTTELQRYKLWLEQKYCSPYTGKVIPLGKLFTEEYQIEHIIPKSRYYDDSFSNKVICEAAVNKLKDKCLGLEFIKNYHGQIVETGFGQKVTIFDEEAYQNFVKQHYAYNRSKRTKLLLEEIPEKMIERQMNDTRYISKFVLPLLSNLVRAEENDNGVNSKNVLPVNGKITTMLKQDWGLNDVWNDLILPRFVRMNELAKTIAFTSWNEQHQKYLPTVPLELSKGFQKKRIDHRHHAMDALVIACATRDHVNLLNNKHANTDTIRYDLQRKLRLFERVTYIDPQTKNNVTKDIPKEFKKPWDNFTVDARNELEKIIVSFKQNLRIINKATNIYTKYENGKKIKVGQKGLNWAIRKPLHKETVFAKVSLRKRKTVRLSEALKDWKKIVDKKLKQEIKRLTCQYGKFDVDTILRYFKDRKYQFGEVDVSKVKMYYFDEENAAVRKNVDTSFTEKFIQGSVTDTGIQKILLNHLEAKGNKVEIAFSPEGIEEMNKNIIQLNEGKLHLPIFKVRVYETIGNKFSVGVKGNKKDKYVEAAKGTNLFFAIYVDENGIRSYETIPLNIVIERLKQGLSVVPEKNRKEHSLLFYLSPNDLVYVPIEDERENIHAVNLDQLNNEQRKRIYKMVSCTGSECHFVPYYVASPIVNKVEYSSLNKIGRSLTGEMIKDVCIKLKVDRLGNVKGISGL

SEQ ID NO: 86 - protein, 1436 aa, Bacteroides sp.
  Bacteroides sp. D2
MKRILGLDLGTNSIGWALVDEAENKDERSSIVKLGVRVNPLTVDELTNFEKGKSITTNADRTLKRGMRRNLQRYKLRRETLMEVLKEHKLITEDTILSENGNRTTFETYRLRAKAATEKISLEEFARVLLMINKKRGYKSCRKAKGAEEGTLIDGMDIARELYNNNLTPGELCLQLLDAGKKYLPDFYRSDLQNELDRIWEKQKEYYPEILTEVLKEELRGKKRDAVWAICAKSFVWEEYYTEWNKEKGKTEQQEREHKLEGIYSKRKRDEAKRENLQWRVNGLKEKLSLEQLVIVLQEMNIQINNSSGYLGAISDRSKELYFNKQTVGQYQMEMLDKNPNASLRNMVFYRQDYLDEFNTLWEKQAEYHKELTGELKKEIRDIVIFYQRRLKSQKGLVGFCEFESRQIEVEIDGKKKIKTVGNRVIPRSSPLFQEFKIWQILNNIEVTVVGKKGKRRKQKDNSPTLFDGLDDTEQLELNGSRYLYQEEKELLAQELFVRDKMTKSDVLKLLFDNPQELDLNFKTIDGNKTGYTLFQAYSKMIEMSGHEPVDFKKTVEKVVEHVKAVFDLLNWNTDILGFNSNEELDNQSYYKLWHLLYSFEGDNTPTGNARLVQKITELYGFEKEYAIILANVTFQDDYGSLSAKAIHKILPHLKEGNRYDVACAYAGYKHSESSLTKEEIANKALKDRLTLLPKNNLRNPVVEKILNQMVNVINAIIDTYGKPDEIRVELARELKKNAKEREELTKFIAETTRKHEEFKILLQSEFGLTNVSRTDILRYKLYKELESCGYKTLYSNTYIPREKLFSKEFDIEHIIPQARLFDDSFSNKTLEARSINLEKGNKTAYDFVKEKFGESGADNSLDHYLNNIEDLFKSGKISKTKYNKLKMAEQDIPDGFINRDLRNTQYIAKKALSMLNEISRRVVATSGTITDKLRQDWQLVDVMKELNWEKYKALGLVEYFEDKDGRQIGRIKDWTKRNDHRHHAMDALTVAFTKDIFIQYFNNKNASLNSNTNEYAIKNKYFQNGRAIAPIPLREFRVEAKKHLENTLISIKAKNKVVTGNINKTKKRGGVNKYLQQTPRGQLHLETIYGSGKQYLTKEEKVNASFDMKKIATVSKSAYRDVLLKRLHENDNDPKKAFTGKNSLDKQPIWLDKEQTRKVPEKVKTVTLETIYTVRKEISPDLKVDKVIDAGVRKILTGRLNEYGNDAKKAFSNLDENPIWLNKEKGISIKRVTISGISNAQSLHVKKDKDGKPILDEDSRNIPVDFVNTGNNHHVAVYRRPVIDKRGQLVIDEAGNPKYELEEVVVSFFEAVTRANLGQPIIDKDYKTSEGWQFLFSMKQNEYFVFPNEKTGFNPKEIDLLDAENYGVISPNLFRVQKFAHKNYVFRHHLETTIKDTSSILKGITWIDFRSSKGLDAIVKVRVNHIGQIVSVGEY

SEQ ID NO: 87 - protein, 1508 aa, Bacteroides uniformis
  Bacteroides uniformis CL03T00C23
MRTILGLDLGTNSIGWAVINSVIKEQTERIWIEMAGSRIIPMDAAILGDFDKGNSISQTAERTRFRGVRRLRERQLLRRERLHKVLKILGFLPEHYLKGIDFEKHTGKFLSGSEPKLPWVKDRWGKYSFLFQTAFNEMLADFAKHQPSLVFDGKKIPYDWTVYYLRKKALTEMISKEELAWILLNFNQKRGYYQLRGEEEEDNAGKSVEFYALKVLSVEATDEKKGRDIWYNVHLENGWVYRRSSNVPLDWEGRVKEFIVTTDLNPDGTPKLDKYGEVKRSFRAPKEDDWMLIKKRTEADITGTHKTIGSYIYDALLQEPQQKIIGKLVKTVERKFYKEELNFILQKQCAFHAELQDRDLYMRCIEALYPGNEVQRRNIANRDFIYLLIDDVLFYQRPLKTKKSLIANCPYEENEYVNRKTGEIKTAPLKCIAKSHPLFQEFRLWYFLSNIRVYQKEREVNGTLHLDVDVTTEFLKTEDDYVALFDWLNSRKEIDQKAFLRYPAFGLKKEINNYRWNYVEDKFYPCNETRHAILSRLEKAGIGIDFLSDEKETALWHILYSVSDKQEIEKALATFAVKNGLNESFVEVFKKFPPFKSEYGAYSAKAIKKLLPLMRCGKYWDMSLIDGTTKERIERIIAGECDESIGAKVREKAMNLSDISCFKRLPLWLACYVVYNRHSEDKEITKWETPADIDAYLAAFKQHSLRNPIVEQVITETLRVVRDIWKQVGKIDEIRIELGREMKNPADKRKRMTTQILENENANLRIKALLAEFVNPEYGVENVRPYSPSQQEILRIYEDAVLKGEEQIPEDIDVILKKFNTSKLPTKSEFLRYKLWLEQKYRSPYTGELIPLAKLFTAAYEIEHVIPQSRYFDDSFSNKVICESAVNKLKDNQLGYEFIKNHHGQKVEVGFGKTVEIFSVDSYERFVKEQYAKSGIKMKKLLMDDIPEQFIERQLNDSRYISKVVKGLLSNIVREKNDSGEYEPEAVSKNILVCTGSVTDRLKKDWGMNDVWNSIVSPRFERLNALTETQCFGHWENKDGKKVFQTAVPLEYQKGFSKKRIDHRHHAMDAIVIACATRNHVNYLNNESASRNAKISRYDLQRLLCDKSRGDGNGNYRWIIKKPWTTFTQDAREALSGIIVSLKQNLRIINKTTNIYQHFDANGTRVYEKQKIGDSWAIRKPMHKDTVFGAVNLRKVKVVRLSVALDTPSMIVNKRVKNKVLELLSYKYDKKKIEKYFKENAFLWKELDIAKVAVYYFTENTTEPLVAVRKSLDSTFNEKKIASVTDTGIQKILLNHLKSKEGKAELAFSAEGIEEMNRNLLQLNDGKGHQPIYKVRVYEPRGNKFKVGVLGNKGAKWVEAAKGTNLFFAIYITEDGNRTYETIPLNWVIEREKQGLVPVPDRNEKGDKLLFWLSPNDLVYLPTEEERDFGRINEPIDRGRIYKMVSSSGNQCFFIPQSISNAIISTKELGSNNKAEKSWDGEMIKNICIPVKVDRLGRIIEVKYRVNE

SEQ ID NO: 88 - protein, 1504 aa, Bacteroides vulgatus
  Bacteroides vulgatus CL09T03C04
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNHPNLITDDKKVPYDWTIYYLRKKGLTSKISKEELAWILLNFNQKRGYYQLRGEEEEENKNKLVEFYALKVVAVEDSGEKKGKDIWYNVHLENGWVYRRTSNMPLDWVGKTKEFIVTTDLEKDGTPKKDKEGNVKRSFRAPKEDDWSLLKKKTEADIDQTHKTVGVYIYDTLLGNPSQKIRGRLVRTIERKYYKEELKQILEKQKEFHLELQDRALYAACIEELYPINEAHRNNVGNRDFTYLFLEDILFYQRPLKSKKSLIDNCPYEENQGLDKETGEIKSFPVKCIAKSHPLFQEFRLWQFIVNLRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEITQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEILRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKFSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSCTGNEGHFIPARIANPILQTIELGSNNKAQKAWTDEMIKEICMPIKVDRLGNVLESSSSYKK

SEQ ID NO: 89 - protein, 1434 aa, Unknown
  Description of Unknown: Bacteroidetes oral taxon 274 str. F0058 polypeptide
MKNILGLDLGTNSIGWAYVKQAQNDSEKSEIAELGVRVNPLTVDEKTNFEKGKPISTNADRTLKRGARRNLQRYKLRRQELIELLKDYQVISDKTILAEDGKETTFETLRLRVKSAKEQVSLEELARILLMINKKRGYKSSRKAKNEDEGQLIDGMEIARRLYDENLTTGQLSLQLLKEGKKSLPDYYRSDLQHELDKVWNFQKQFHPDILTDEFYTSIQGKGQKATRESFSSKYGIDTAENKGSREEKKLQAYQWRADATHKELTKEELAFVITEINNNINNSSGYLGAISDRSKELIFANETVGEYLWKQIQNDPHTSLKNQVFYRQDYFDEFERIWETQSGFYPQILTESLKNELRDILIFYQRKLKSQKALVSICEFESKEIPLKDKQGNPISKNGIPVTKLVGPKVAPKSSPLFQEFKIWQNLNNVLVRPKGSRKRKVTTNQQSTLLEGQEPVFELNLEQKELLFEELNLKGNLKTDYCLELIGYSAKEWEMNYPTLEGNKTNKALYEAYLKIIDSEGYDAKKLLKVKTDKDDINLDDIKVSASEIKTMISDIFNELGINTKILDFDAELERKQFEAQASYRLWHLLYSYEGDDSKSGNELLYRLLEDKFGFKREHSKTLANVSLLSDYGNLSTKAIRTIYPYIKENKFSTACELAGYRHSKLSISKEENENRTLKDTLDVLKKNSLRQPVVEKILNQMINLINELIEKHSEKDEKGNIVKYFKFDEIHIELARELKKNAEERRELDSKVREGKDRNEKIITILKSEFGLPYPTKNDITRYRLYEELKDNGYKDLYTNTYIPREKLFSKEIDIEHIIPKSRLFNDSFSNKTICYRQDNLNKGERTAYDYIEGLGKTQLDEYLNRVENLYTNKFITKAKYRNLLKKESEIGDGFIERDLRETQYIAKKAKEMLLQITRHVVSTTGSITDRLRDDWELVNVMRELNLPKYKVLGLTEIQERKNGQTVEVITDWTKRNDHRHHAMDALTVAFTKHSHIQYLNFLNARKDEKHKEYSNIMGIQQLETEKTTDKDGKDRRVFKTPIPNFRQVAKEHLESILISHKTKNKVVTRATNKIAGSKKQQETLSPRGQLHKETVYGKYRRYVQKEEKIGSKFDLQTIERVANPLYKRLLTKRLEENGGDPKKAFTGKNALAKSPIYLDETQTQQLPEKVKLVWLETDFSIRKDITPDNFKDEKSIDKVLDEGIKRILKDRLKSFDGDAKRAFTDLEQNPIWLNKEKGIAIKRVTISGVSNAEPLHTKKDHLGNEIFDDTGKPIPVDYVSTGNNHHIAIYRDENGNLQEKAVSFFEAVTRANQGLPTVDKTYNQHLGWQFLFTMKQNEMFVFPNKETGFDPQEIDLLDPKNKKLISPNLFRVQKISTKNYFFRHHLETSVETHNALNGVTYKSQLGLNGITDIIKVRINHLGDIVHIGEY

SEQ ID NO: 90 - protein, 1153 aa, Barnesiella intestinihominis
  Barnesiella intestinihominis YIT 11860
MKNILGLDLGLSSIGWSVIRENSEEQELVAMGSRVVSLTAAELSSFTQGNGVSINSQRTQKRTQRKGYDRYQLRRTLLRNKLDTLGMLPDDSLSYLPKLQLWGLRAKAVTQRIELNELGRVLLHLNQKRGYKSIKSDFSGDKKITDYVKTVKTRYDELKEMRLTIGELFFRRLTENAFFRCKEQVYPRQAYVEEFDCIMNCQRKFYPDILTDETIRCIRDEIIYYQRPLKSCKYLVSRCEFEKRFYLNAAGKKTEAGPKVSPRTSPLFQVCRLWESINNIVVKDRRNEIVFISAEQRAALFDFLNTHEKLKGSDLLKLLGLSKTYGYRLGEQFKTGIQGNKTRVEIERALGNYPDKKRLLQFNLQEESSSMVNTETGEIIPMISLSFEQEPLYRLWHVLYSIDDREQLQSVLRQKFGIDDDEVLERLSAIDLVKAGFGNKSSKAIRRILPFLQLGMNYAEACEAAGYNHSNNYTKAENEARALLDRLPAIKKNELRQPVVEKILNQMVNVVNALMEKYGRFDEIRVELARELKQSKEERSNTYKSINKNQRENEQIAKRIVEYGVPTRSRIQKYKMWEESKHCCIYCGQPVDVGDFLRGFDVEVEHIIPKSLYFDDSFANKVCSCRSCNKEKNNRTAYDYMKSKGEKALSDYVERVNTMYTNNQISKTKWQNLLTPVDKISIDFIDRQLRESQYIARKAKEILTSICYNVTATSGSVTSFLRHVWGWDTVLHDLNFDRYKKVGLTEVIEVNHRGSVIRREQIKDWSKRFDHRHHAIDALTIACTKQAYIQRLNNLRAEEGPDFNKMSLERYIQSQPHFSVAQVREAVDRILVSFRAGKRAVTPGKRYIRKNRKRISVQSVLIPRGALSEESVYGVIHVWEKDEQGHVIQKQRAVMKYPITSINREMLDKEKVVDKRIHRILSGRLAQYNDNPKEAFAKPVYIDKECRIPIRTVRCFAKPAINTLVPLKKDDKGNPVAWVNPGNNHHVAIYRDEDGKYKERTVTFWEAVDRCRVGIPAIVTQPDTIWDNILQRNDISENVLESLPDVKWQFVLSLQQNEMFILGMNEEDYRYAMDQQDYALLNKYLYRVQKLSKSDYSFRYHTETSVEDKYDGKPNLKLSMQMGKLKRVSIKSLLGLNPHKVHISVLGEIKEIS

SEQ ID NO: 91 - protein, 1352 aa, Belliella baltica
MKKILGLDLGTTSIGWAFIKEPEKDVVGSEIVDMGVRIVPLSSDEENDFAKGNTISINADRTLKRGARRNLQRFKQRRNALLEIFKEKKLISTNFKYAEDGPSSTFSTLNLRAKAAKEKIELQDLVKVLLQINKKRGYKSSRKAKSEEDDGSAIDSMGIAKELYENDLTPGQWVYEALQKGRKNVPDFYRSDLQEEFKKIVNYQSEFFPDIFNASFVEDWMGKASTPTKQYFNKKGVQLAENKGKREERRLQEYKWRAEAVNFKIDLSEIALILSQINSQISNSSGYLGAISDRSKELYFKNLTVGQYLYQQIKKNPHTRLKGQVFYRQDYLDEFERIWSVQSSFYPQLNDALKREVRDITIFFQRRLKSQKHLISNCEFEDHHKVVPKSHPVFQEFRIWQNLNNLLLIKKDNLNEKFDLELESKIALANELAFKRELNVKDALKILGLKPNEWEFNFTKIEGNRTNQAFFDAFAKIIELEDGEPIDLGDLKADDILDQFSEAFLRIGIDTELLQVNSDIEGAEYEKQSYIQFWHLLYSSEDDQKLKLNLIRKFGFKPEHAKILASISLQDDHASLSSRAIKKILPHLQSGLIYDKACTYAGYNHSSSFTKDENEKRELRAELELLKKNSLRNPVVEKILNQMINVVNAILKDPELGRPDEIRVEMARELKANAEQRKNMTSNIASATRDHDKYREILKSEFGLKRVTKNDLLRYKLWLETDGISLYTGKPIEASKLFSKEYDIEHIIPKARLFDDSFSNKTICERQLNIDKANVTAFSFLQNKLSADEFEQYQSRVKSLYGKLSKAKIQKLLMANDKIPEDFIARQLQETRYISKKAKEILFEISRRVSVTTGTITDKLREDWGLVEIMKELNWEKYDKLGLTYTIEGKHGERLNKIKDWSKRNDHRHHAMDALTVALTKPAYIQYLNNLNAKGLNNKKGTEVFAIEQKYLKRENGKLCFIPPIENIRSEAKKHLSRILVSYKAKNKVVTINKNKTKSKAGLNEQIALTPRGQLHKETVYGKSFHYSTKFEKIGASFNVQKINTVAKKEEREALLKRLAENGNDPKKAFTGKNTLNKMPIYLDLGKNIKLSEKVKTVVLEQNYTIRKNIDPDLKVDKVIDVGIKRILESRLEEFGGNAKLAFSNLEENPIWLNKEKGISIKRVKISGVSNVESLHVKKDHFGEPILDQEGNEIPVDFVSTGNNHHVAIYEDENGNLQEEVVSFFEAVVRQNQGLPIIKKNHTLGWKFLFTLKQNEYFVFPSDDFVPADVDLMDEQNYHLISPNLFRVQKIARKNYVFNNHLETKAVDNDLLKSKKELSKITYHFYQTPEHLRGIIKIRINHLGKIIQIGEY

SEQ ID NO: 92 - protein, 1415 aa, Bergeyella zoohelcum
  Bergeyella zoohelcum ATCC 43767
MKHILGLDLGTNSIGWALIERNIEEKYGKIIGMGSRIVPMGAELSKFEQGQAQTKNADRRTNRGARRLNKRYKQRRNKLIYILQKLDMLPSQIKLKEDFSDPNKIDKITILPISKKQEQLTAFDLVSLRVKALTEKVGLEDLGKIIYKYNQLRGYAGGSLEPEKEDIFDEEQSKDKKNKSFIAFSKIVFLGEPQEEIFKNKKLNRRAIIVETEEGNFEGSTFLENIKVGDSLELLINISASKSGDTITIKLPNKTNWRKKMENIENQLKEKSKEMGREFYISEFLLELLKENRWAKIRNNTILRARYESEFEAIWNEQVKHYPFLENLDKKTLIEIVSFIFPGEKESQKKYRELGLEKGLKYIIKNQVVFYQRELKDQSHLISDCRYEPNEKAIAKSHPVFQEYKVWEQINKLIVNTKIEAGTNRKGEKKYKYIDRPIPTALKEWIFEELQNKKEITFSAIFKKLKAEFDLREGIDFLNGMSPKDKLKGNETKLQLQKSLGELWDVLGLDSINRQIELWNILYNEKGNEYDLTSDRTSKVLEFINKYGNNIVDDNAEETAIRISKIKFARAYSSLSLKAVERILPLVRAGKYFNNDFSQQLQSKILKLLNENVEDPFAKAAQTYLDNNQSVLSEGGVGNSIATILVYDKHTAKEYSHDELYKSYKEINLLKQGDLRNPLVEQIINEALVLIRDIWKNYGIKPNEIRVELARDLKNSAKERATIHKRNKDNQTINNKIKETLVKNKKELSLANIEKVKLWEAQRHLSPYTGQPIPLSDLFDKEKYDVDHIIPISRYFDDSFTNKVISEKSVNQEKANRTAMEYFEVGSLKYSIFTKEQFIAHVNEYFSGVKRKNLLATSIPEDPVQRQIKDTQYIAIRVKEELNKIVGNENVKTTTGSITDYLRNHWGLTDKFKLLLKERYEALLESEKFLEAEYDNYKKDFDSRKKEYEEKEVLFEEQELTREEFIKEYKENYIRYKKNKLIIKGWSKRIDHRHHAIDALIVACTEPAHIKRLNDLNKVLQDWLVEHKSEFMPNFEGSNSELLEEILSLPENERTEIFTQIEKFRAIEMPWKGFPEQVEQKLKEIIISHKPKDKLLLQYNKAGDRQIKLRGQLHEGTLYGISQGKEAYRIPLTKFGGSKFATEKNIQKIVSPFLSGFIANHLKEYNNKKEEAFSAEGIMDLNNKLAQYRNEKGELKPHTPISTVKIYYKDPSKNKKKKDEEDLSLQKLDREKAFNEKLYVKTGDNYLFAVLEGEIKTKKTSQIKRLYDIISFFDATNFLKEEFRNAPDKKTFDKDLLFRQYFEERNKAKLLFTLKQGDFVYLPNENEEVILDKESPLYNQYWGDLKERGKNIYVVQKFSKKQIYFIKHTIADIIKKDVEFGSQNCYETVEGRSIKENCFKLEIDRLGNIVKVIKR

SEQ ID NO: 93 - protein, 1430 aa, Bergeyella zoohelcum
  Bergeyella zoohelcum CCUG 30536
MKHILGLDLGTNSIGWAVVKEAQNDNEQSEIVDVGVRVNPLTTDEKTNFEKGKPISTNADRTLKRSARRNLQRYKLRRKELIELLKEHQLISTDTILTENGKGTTFQTLELRAKSAKEKISLEELARVFLTINKKRGYKSSRKAKNEDEGQLIDGMEIAKRLYEENLTTGQLSLQLLKEGKKSLPDYYRSDLQFELDKVWNFQKQFHSDILTDEFYAQLKGKGQRATSALFLAKYQIYTAENKGSREDKKLQAYQWRVDALSKELTREQLAFVITEINNNLNNSSGYLGAISDRSKELYFNNETVGEYLWKQIAANPHTSLKNQVFYRQDYLDEFEQIWKTQSAFYPEILTDELKKELRDVVIFYQRKLKSQKSLVSFCEFENKEIEIKKEDGTSTKKVIGLKVAPKSSPLFQEFKIWQNLNNVLIRKKGSKTKKVAKNQQAVLFEEEKTISELDLEAKQALFNELNLKGNLKADYCLEILGYSPKEWEMNYSVLEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRVLKDSLEVLKKNSLRQPVVEKILNQMINLVNALLKKYRTENPNFKFDEIRIELARELKKNAEERANMTANINKAKTEHEKIIKILKNEFGLPNPTRNDIIRYRLYEELKANGYKDLYTNIKIPQEKLFTKEIDIEHIIPKSRVFDDSFSNKTLSFRKTNLDKGERTAFDYMESKFGADKLEEYVARVEDLYKNNIISKAKYQKLLKKESEIGDGFVERDLRETQYIAKKAKEILLQITPNVLSTSGGITDRLREDWDLINVMKELNLPKYRALGLTQMEDRKYGQQVEVITDWTKRNDHRHHAMDALTVAFTKHNHIQYLNYLNARKNEKHKEHSNIMGIQQLETIKVTDKNGNEKRVFKAPMPNFRQVTKAFLENILISHKAKNKVVTKNKNKVAGSNKVQEVLTPRGQLHKETVYGKYQYYVQKEEKIGAKFDLETIKKVANPLYQSLLKKRLEENGGDPKKAFTGKNSLAKNPIYLDDTQTEQLPEKVKLVWLENSFSIRKDITPENFKDEKLIDKILDEGVKRILKERLQSFGNDAKKAFSDLDKNPIWLNKEKGITIKRVTISGVANAEPLHTKKDHLGKEILDKEGKPIPVDFISTGSNHHVAVYRDEKGNLQEKVVSVFEAVVRANQGLPIIDKTYNQHLGWEFLFTMKQNEMFVFPNESTGFNPNDIDLLDPKNKRIISPNLFRVQKFSKLQYGNSFVREFVFRHHLETTVEDRKELQGITYKQMKNSTFFNDIIKVRINHLGDIVSIGEY

SEQ ID NO: 94 - protein, 1420 aa, Bifidobacterium bifidum
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLTFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 95 - protein, 1138 aa, Bifidobacterium dentium
MLCRCHRRYRIGIDVGLMSVGLAAIEVDETGFPIRILNIQSVIHDGGIDPQLGKKKSISRKAISGVARRTRRMRRRKVVRLRQLDATLESLGFPIVEPDSLDTWEIWLTRAKLASSYIQDDETRKEDVSIALRHIARHRGWRNPYSNVESLFVDVAPSEQYEELRRKAEEKLGTSLSGNPTSAEIVECILKRQVGEVQLRTRSRKGVNGNAVEKEGLLPTKLMQSDNAAEIRRIFKVQRIDDETGRKLLRAVFKACSPKGSVERRVGRDALAPGLPRALKASLAFQEYRIANVLTNLVISEDGTKRKLTIAEKQRVFGFLSSNETDDITWIDVAEKLGLERRQIQGVGCLTADGEERISSTPPRNITALHIHSAKPVIREKLVAWWKAASPTVRETMVELLSNTVDIDRVREDMDYSSAVAFIDSLGDEELTALDSVDLLSGRAAYSRQTLKQLTERMLNTDDDLHEARKAVFGVDDNWKPPVDAISTSVGNPAVDRVLKIVNRYLLACQKRWRNPQSVQIEHVRESFSSVAKAKETERVQGERARYRNDLRRELCEQEGLNKIRESDIRRWESVQRQNGTCLYCGSPITFRTCEMDHIVPRKGVGSTNTRVNLAAACAACNKLKSNTAFSVWARTEGAANRKVSQRDAIERVKTFIFNKSVPPREQRAFKQAVISRLRQAESDPAIDNRSIESVAWMADELHRRIEAYFNQDADVSGNTPATQVWVFQGRVTALARKASGIEGRIHFAGEWKKTRLDRRHHAVDAAVIAMMNHSAAQTLVERDSLRLSQWITRKPETWKNYPFSEGQKKTRFKEWLDCMNALLDLLNDALDSDRVPVTRCQRMSLGNSQAHAATIRKMKRVELFSPMDADLIRRASTPALYCALTRLPEYSPEKGLPENRGREIVLNGRHIRSTETVDFFASGAAQLMVRNGSAEIGDSIHHMRIYRYRKTGAKSQEYVYGMIRVFQIDLLHASSENLFAVQLPSQSVSVRYGDKNVVQAIQEGRAEYLGHIVPNDEILISYEGVRMKDSEKIGAYANDFSGTASELAQRRHWVVVGSDVSKLALRPSYLSEEGLENSGSESERLSKQTRKVIEGKGWVVAVNILAKYHPVVIRRNALGEPRFRTNSGMPVSWRWDR

SEQ ID NO: 96 - protein, 1187 aa, Bifidobacterium longum
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 97 - protein, 1124 aa, Bifidobacterium longum
  Bifidobacterium longum subsp. longum 2-2B
LTGHSGHTFWPTSSSPPIQLEQEKRPLPQRNTSQNGHTFWPITRERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFPVSMLMVRLASIYNSSRSLVEGTLHGNIGLLMDSLTRRS

SEQ ID NO: 98 - protein, 1138 aa, Bifidobacterium sp.
MNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 99 - protein, 1151 aa, Bifidobacterium sp.
  Bifidobacterium sp. 12_1_47BFAA
MRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 100 - protein, 1092 aa, Brevibacillus laterosporus
  Brevibacillus laterosporus GI-9
MAYTMGIDVGIASCGWAIVDLERQRIIDIGVRTFEKAENPKNGEALAVPRREARSSRRRLRRKKHRIERLKYMFVRNGLAVDIQHLEQTLRSQNEIDVWQLRVDGLDRMLTQKEWLRVLIHLAQRRGFQSNRKTDGSSEDGQVLVNVTENDRLMEEKDYRTVAEMMVKDEKFSDHKRNKNGNYHGVVSRASLLVEIHTLFESQRQHHNFLASKDFELEYINIWSSQRPVATKDQIEKMIGTCTFLPKEKRAPKASWHFQYFMLLQTINHIRITNAQGTRPLNKEEIEQVVNMALTKSKVSYHDIRKVLDLSEEYQFVGLDYGKEDEKKKVESKETIIKLDDYHKLNKIFNEVELAKGETWEAVDYDTVAYALTFFKDDEDIRDYLQNKYKDSKNRLVKNVANKEYTNELIEKVSTLSFRKVGHLSLKALRKIIPFLEQGMTYDKACQAAGFNFQGISKKKRSVVLPVIDQISNPVVNRALTQTRKVINALIKKYGSPETIHIETARELSKRFDERKNITKDYKENRDKNERAKKHLSELGIINPTGLDIVKYKLWCEQQGRCMYSNQPISFERLRESGYTEVDHIIPYSRSMNDSYNNRVLVMTRENREKSNQTPYEYMGNDTQRWDEFEQRVTTNPQIKKEKRQNLLLKGFTNRRELEMLERNLNDTRHITKYLSHFISTNLEFSPSDKKKKVVNTSGRITSHLRSRWGLEKNREQNDLHHAMDAVVIAVTSDSFIQQVTNYYKRKERRELNGDDKFPLPWKFFREEVIARLSPNPKEQIEALPNHFYSEDELADLQPIFVSRMPKRSITGEAHQAQFRRVVGKTKEGKNITAKKTALVDISYDKNGDFNMYGRETDPATYEAIKERYLEFGGNAKKAFSTDLHKPKKDGTKGPLIKSVRIMENKTLVHPVNKGKGVVYNSSIVRTDVFQRKEKYYLLPVYVTDVTKGKLPNKVIAAKKGYDDWIEVDDSFTFLYSLYPNDLIFIRQNPKKKISLKKRIESHSISDSKEVQEILTYYKGVDSSTAAIEFITHDGSYYAKGVGVQNLDCFEKYQVDILGNYSKVKGEKRLELETSDNNHKGKDVNSIKSTSR

SEQ ID NO: 101 - protein, 1428 aa, Burkholderiales bacterium
  Burkholderiales bacterium 1_1_47
MGKTHIIGVGLDLGGTYTGTFITSHPSDEAEHRDHSSAFTVVNSEKLSFSSKSRTAVRHRVRSYKGFDLRRRLLLLVAEYQLLQKKQTLAPEERENLRIALSGYLKRKGYARTEAETDTSVLESLDPSVFSSAPSFTNFFNDSEPLNIQWEAIANSPETTKALNKELSGQKEADFKKYIKTSFPEYSAKEILANYVEGRRAILDASKYIANLQSLGHKHRSKYLSDILQDMKRDSRITRLSEAFGSTDNLWRIIGNISNLQERAVRWYFNDAKFEQGQEQLDAVKLKNVLVRALKYLRSDDKEWSASQKQIIQSLEQSGDVLDVLAGLDPDRTIPPYEDQNNRRPPEDQTLYLNPKALSSEYGEKWKSWANKFAGAYPLLTEDLTEILKNTDRKSRIKIRSDVLPDSDYRLAYILQRAFDRSIALDECSIRRTAEDFENGVVIKNEKLEDVLSGHQLEEFLEFANRYYQETAKAKNGLWFPENALLERADLHPPMKNKILNVIVGQALGVSPAEGTDFIEEIWNSKVKGRSTVHSICNAIENERKTYGPYFSEDYKFVKTALKEGKTEKELSKKFAAVIKVLKMVSEVVPFIGKELRLSDEAQSKFDNPYSLAQLYNLIETERNGFSKVSLAAHLENAWRMTMTDGSAQCCRLPADCVRPFDGFIRKAIDRNSWEVAKRIAEEVKKSVDFTNGTVKIPVAIEANSFNFTASLTDLKYIQLKEQKLKKKLEDIQRNEENQEKRWLSKEERIRADSHGICAYTGRPLDDVGEIDHIIPRSLTLKKSESIYNSEVNLIFVSAQGNQEKKNNIYLLSNLAKNYLAAVFGASDLSQITNEIESTVLQLKAAGRLGYFDLLSEKERACARHALFLNSDSEARRAVIDVLGSRRKASVNGTQAWFVRSIFSKVRQALAAWTQETGNELIFDAISVPAADSSEMRKRFAEYRPEFRKPKVQPVASHSIDAMCIYLAACSDPFKTKRMGSQLAIYEPINFDNLFTGSCQVIQNTPRNFSDKTNIANSPIFKETIYAERFLDIIVSRGEIFIGYPSNMPFEEKPNRISIGGKDPFSILSVLGAYLDKAPSSEKEKLTIYRVVKNKAFELFSKVAGSKFTAEEDKAAKILEALHFVTVKQDVAATVSDLIKSKKELSKDSIENLAKQKGCLKKVEYSSKEFKFKGSLIIPAAVEWGKVLWNVFKENTAEELKDENALRKALEAAWPSSFGTRNLHSKAKRVFSLPVVATQSGAVRIRRKTAFGDFVYQSQDTNNLYSSFPVKNGKLDWSSPIIHPALQNRNLTAYGYRFVDHDRSISMSEFREVYNKDDLMRIELAQGTSSRRYLRVEMPGEKFLAWFGENSISLGSSFKFSVSEVFDNKIYTENAEFTKFLPKPREDNKHNGTIFFELVGPRVIFNYIVGGAASSLKEIFSEAGKERS

SEQ ID NO: 102 - protein, 1442 aa, Caenispirillum salinarum
  Caenispirillum salinarum AK4
MPVLSPLSPNAAQGRRRWSLALDIGEGSIGWAVAEVDAEGRVLQLTGTGVTLFPSAWSNENGTYVAHGAADRAVRGQQQRHDSRRRRLAGLARLCAPVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPFLRTWTGNAATDHILNQVRKTANEVITKYGNRRGWDPLPSRITVELAREAKHGVIRRNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRMLHDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDRQDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTILKEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 103 - protein, 984 aa, Campylobacter coli
  Campylobacter coli 1098
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 104 - protein, 984 aa, Campylobacter coli
  Campylobacter coli 111-3
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 105 - protein, 987 aa, Campylobacter coli
  Campylobacter coli 132-6
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 106 - protein, 984 aa, Campylobacter coli
  Campylobacter coli 151-9
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSNDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 107 - protein, 984 aa, Campylobacter coli
  Campylobacter coli 1909
MARILAFDIGISSIGWAFSENDELKDCGVRIFTKAENPKTGESLALPRRLARSARKCLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 108 - protein, 965 aa, Campylobacter coli
  Campylobacter coli 1957
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKEKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNAENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKILTFKKLNDLKQGKTPFEAFGEDEKLWAEINERIKEYNGKKRFKIFDKFFKDKKPFDFTEQTLQDTRWLTKLVASYLNEYLLFLPINEDENTALGYGEKGSKQHVVLSSGMITQMLRNFWYLGFKNHKDYKNNAMDAIIVAFTTNSIIFAFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANAKGSLVRTDLFADKENKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIVVGKILEIKKYSISPSGELSLIENEERKWF

SEQ ID NO: 109 - protein, 984 aa, Campylobacter coli
  Campylobacter coli 2692
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLTNYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 110 - protein, 984 aa, Campylobacter coli
  Campylobacter coli 59-2
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFSDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 111 - protein, 965 aa, Campylobacter coli
  Campylobacter coli 67-8
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKAKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNAENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKVLTFKKLNDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVVLSSGMITQMLRNFWYLGFKNHKNYKNNAMDAIIVAFTTNSIIFAFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANTKGSLVRTDLFVDKENKFHAVSIYKADFSTKKLPNKTPATTSNGETKEGIEMNENYNFCMSLYKNTPVSVKIKGMKEPIICYYHGFNTSGSKITYKKHDNNYHNLSEDEMVVFRKNDKESIVVGKILEIKKYSISPSGELSLIENEKRKWF

SEQ ID NO: 112 - protein, 965 aa, Campylobacter coli
  Campylobacter coli 80352
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKAKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNVENSKLVDLKKLNEFKKALGDGFTNLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKVLTFKKLNDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVILSSGMITQMLRNFWYLGFKNHKDYKNNAMDAIIVAFTTNSIIFTFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANAKGSLVRTDLFADKENKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIVVGKILEIKKYSISPSGELSLIENEERKWF

SEQ ID NO: 113 - protein, 987 aa, Campylobacter coli
  Campylobacter coli 80352
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 114 - protein, 984 aa, Campylobacter jejuni
MAKILAFDIGISSIGWAFSENDELKDCGVRIFTKAENPKTGESLALPRRIARSARKRLARRKARLNHLKHLIANEFKLNYEDYQSFDEILAKAYKGSLISPYELRFRALNELLSKQDFARVILHIAKRRGYDDIKNNGDEEKGKILKAIKQNEEKLANYQSVGEYLYKEYFQKFKENSKEFINVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTLYTKDDLNALLNEVLKNGTLTYKQTKKLLGLSDDYEFKGEKGNYFIEFKKYKEFIKALGEHSLSQDDLNEIAKDITLIKDEIKLKKALAKYDLNENQIDNLSKLEFKDHLNISFKALKLITPLMLEGKKYDEACNELTLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKLSDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNTAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREEFKNELR

SEQ ID NO: 115 - protein, 987 aa, Campylobacter jejuni
  Campylobacter jejuni subsp. jejuni 110-21
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDNIKNSDNEEKSEILKAIKQNEEKLVNYQSVGEYLYKEYFQKFKENSKEFINVRNKKESYERCIAQSFLKDELKLIFQKQREFGLSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVVINEDKKDFLPAFNETYYKDEVTNPVVLRAIKEYRKVLNALLKKYGKVHKINIELAREVGKNHSQRAKIEKEQNENYKAKKDAELECEKLGLKINNKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPTKKQKRILDKNYKDKEQKDFKDRNLNDTRYIARLVLNYTKDYLDFLPLSDDENTKLNDIQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 116 - protein, 987 aa, Campylobacter jejuni
  Campylobacter jejuni subsp. jejuni 129-258
MARILAFDIGISSIGWAFSENDELKDCGVRIFTKAENPKTGESLALPRRLARSARKRLARRKARLNHLKHLIANEFKLNYEDYQSFNESLAKAYKGSLISPYELRFRALNELLSKQDFARVILHIAKRRGYDDIKNSDDKEKGAILKVIKQNEEKLANYQSVGEYLYKEYFQKFKENSKEFTNVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 117 - protein, 987 aa, Campylobacter jejuni
  Campylobacter jejuni subsp. jejuni 1336
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVSYQSVGEYLYKEYFQKFKENSKEFINVRNKKESYERCIAQSFLKDELKLIFQKQREFGFSFSKKFEEEVLSVAFYKRALKDFSHLVGNCSFLLMKKERQKNSPLAFMFVALTRIINLLNNLKNTEGILYTKDDLNTLLNEALKNGTLTYKQTKKLLGLSNDYEFKGEKGTYFIEFQKYKEFVKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNKTPFETFGNDRVKWQKIEVLAKNLPTKKQKRILDKNYKDKEQKDFKDRNLNDTRYIARLVLNYTKDYLDFLPLSDDENTKLNDTQKGSKVHVEAKSGMLTSTLRHTWGFSTKDRNNHLHHAIDAAIIAYANNSIVKAFSDFKKEQESNTAELYAKKISELDYKNKRKFFEPFSGFRQKLLDKIDEIFVSKPERKKPSGALHEETFRKEEEFYQSYGGKEGVLKALELGKIRKVNGKMVKNGDMFRVDIFKHKKTNKFYAVPIYTMDFALKVLPNKAVVQGKDKKSGLIKDWILMDENYEFCFSLYKDSLILIQTKDMQEPELVYYERLDSSNASLTVSKHDNKFETLSKNQKILFKNANEKEVIAKSIGIQNLKVFEKYIVSALGEVTKAEFRQREDFKK

SEQ ID NO: 118 - protein, 984 aa, Campylobacter jejuni
  Campylobacter jejuni subsp. jejuni 140-16
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFIQREDFKK

SEQ ID NO: 119 - protein, 984 aa, Campylobacter jejuni
  Campylobacter jejuni subsp. jejuni 1577
MARILAFDIGISSIGWAFSENDELKDCGVRIFTKVENPKTGESLALPRRLARSARKRLARRKVRLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 120 - protein, 987 aa, Campylobacter jejuni
  Campylobacter jejuni subsp. jejuni 1854
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKSLGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 121 - protein, 984 aa, Campylobacter jejuni
  Campylobacter jejuni subsp. jejuni 1997-10
MARILAFDIGISSIGWAFSENDELKDCGVRIFTKAENPKTGESLALPRRLARSARKRLARRKARLNRLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLNQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVYVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 122 - protein, 987 aa, Campylobacter jejuni
  Campylobacter jejuni subsp. jejuni 2008-1025
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 123 - protein, 984 aa, Campylobacter jejuni
  Campylobacter jejuni subsp. jejuni 2008-872
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 124 - protein, 987 aa, Campylobacter jejuni
  Campylobacter jejuni subsp. jejuni 2008-979
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLVNYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSEKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 125 - protein, 965 aa, Campylobacter jejuni
  Campylobacter jejuni subsp. jejuni 2008-988
MKIIGFNLGIANIGWALRENDEIIDCGVRVFDIPENPKNGNSLALERRENKARMKIVKRKKARMLATKTFLKKELNVDLSKLFLIGSTQSIYELRAKALSSLISKEELSAIILHIAKHRGYDDSALKNENGTIIEALNKNKETMLKFKSVGEYFYKNFVQNKEVKKIRNTTEDYSNSVPRSLLKQELDLILDKQKELGLIKNADFKEKLFEIIFFKRPLKDFSNKIGNCIFFENEKRAAKNTISACEFVALGKVVNLLKSIEKDIGIVYEKDSINEIMSIILDKTSISYKKIRDILNLPQEINFKGLDYSKNNVENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKSEYLPLFEKTRFAKDISSPVVIRAICEFRKLLNDIIRRYGSVHKIHLELTRDFGISFSDRKKIIKEIEQNEQSRIKALETIKELKLEETSKNIQIVRLFEDQKGICPYSGLKMDLNRLDELVIDYIRPYNRSLDDSYSNKVLTFKKLSDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVILSSGMITQMLRNFWYLGFKNHKDYKNNAMDAIIVAFTTNSIIFAFNNFKKELDLAKAEFYANKISESDYLLKRKFLPPFSGFKEQALEKVKNIFVSHSLKIKNKGTLHDLTPLKIKELKNTYGDLDLAVKLGKIRKYNDKYYANANGSLVRADLFVDKKNKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIAVGKILEIKKYSISPSGELSLIENEERKWF

SEQ ID NO: 126 - protein, 984 aa, Campylobacter jejuni
  Campylobacter jejuni subsp. jejuni 2008-988
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVTLTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 127 - protein, 961 aa, Campylobacter jejuni
  Campylobacter jejuni subsp. jejuni 260.94
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFSDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNIGFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKLSDLQDEKMLEIDHIYPYSRSFDDSYMNKVLVFTKQNQEKLNKTPFEAFGNDNVKWQKIEVLAKNLPEKKQKRILDKNYKDKEQKDFKDRNLNDTRYIARLVLNYTKDYLDFLPLSDDENTKLKGSKVHVEAKSGMLTSALRHTWGFSTKDRNNHLHHAIDAAIIAYANNSIVKDFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNLKVFEKYIVSALGEVTKAEFRQREDFKNELR

SEQ ID NO: 128 - protein, 985 aa, Campylobacter jejuni
  Campylobacter jejuni subsp. jejuni 414
MAKILAFDIGISSIGWAFVENDELKDCGVRIFTKAENPKTGESLALPRRLARSARKRLARRKARLNHLKHLIANEFKLNYEDYQSFDESLAKAYKGTLISPYELRFKALNELLSKQDLARVILHIAKRRGYDNIKNSDDKEKGAILKAVKENEEKLANYKSVGEYLYKEYFQKFKENSKEFINVRNKKESYERCIAQSFLKDELKLIFQKQREFGFNFSKKFEEEVLSVAFYKRALKDFSHLVGNCSFFVDEKRAPKNSPLAFEFVALTRIVNLLNNLNKNNSYIKDDLNALLSEVLKNGTLTYKQTKKILGLSDDYEFKGQKGNYFIEFKKYKEFIKALCEHNLNQDDLNEIAKDITLVKDETKLKKALAKYDLNQNQIENLSKIEFKDHLNISFKALKLIVPLMREGKKYDEVCNELNLKTAINEDKKEFLPAFNETYYKDEVNNPVVLRAIKEYRKVLNSLLKKYGKVHKINIELAREVGKNHRERSKIEKEQNENFKAKKDAELECEKLGLKINSKNILKLRLFKEQKEFCVYSGEKIKISDLQDEKMLEIDHIYPYSRSFDDSYMNKVLVFTKQNQEKLNKTPFEAFGKDDVKWQKIETLAKNLPAKKQKRILDKNYKDKEQKDFKDRNLNDTRYIARLVLNYTKDYLEFLPLSDDENIKLNDTQKGSKVHVEAKSGMLTSVLRHTWGFSTKDRNNHLHHAIDAVIIAYANASVVKAFSDFKKEQENYTAELYAKKINELDFKNKRKFFEPFSNFRQKVLEKIDEIFVSKPERKKPSGALHEETFYKEEEFYKEYGGKEGVLKALELGKIRKVNGKIVSNANMFRVDIFKYKKTNKFYAVPIYTMDFALGILPNKAVVGGKDKQGIIKDWLLMDENYEFCFSLYKDSLILLQTKDMQEPELVYFKSFKSSTAGLVVSKHDNKFENLNENQKKLFKSANEKKVVAEGIGIQNLKVFEKYIVSALGEITKAEIKERENFKKK

SEQ ID NO: 129 - protein, 984 aa, Campylobacter jejuni
  Campylobacter jejuni subsp. jejuni 51037
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIVKRRGYDDIKNSDDKEKGTILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 130 - protein, 984 aa, Campylobacter jejuni
  Campylobacter jejuni subsp. jejuni 51494
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGLKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 131 - protein, 987 aa, Campylobacter jejuni
  Campylobacter jejuni subsp. jejuni 53161
MARILAFDIGISSIGWAFSENDELKDCGVRIFTKAENPKTGESLALPRRLARSARKRLARRKARLNHLKHLIANEFKLNYEDYQSFDEGLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 132 - protein, 984 aa, Campylobacter jejuni
  Campylobacter jejuni subsp. jejuni 60004
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 133 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAAIIAYANNSIVKAFSDFKKEQESNSVELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 134 - protein, 984 aa, Campylobacter jejuni
  Campylobacter jejuni subsp. jejuni 84-25
MVRILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 135 - protein, 984 aa, Campylobacter jejuni
  Campylobacter jejuni subsp. jejuni 87459
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTFLNEVLKNGTLTYKQTKKLLGLSDDYEFKGEKGTYFIEFKKYKEFIKALGDHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 136 - protein, 984 aa, Campylobacter jejuni
  Campylobacter jejuni subsp. jejuni ATCC 33560
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHTIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 137 - protein, 987 aa, Campylobacter jejuni
  Campylobacter jejuni subsp. jejuni CF93-6
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRVPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYGVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 138 - protein, 984 aa, Campylobacter jejuni
  Campylobacter jejuni subsp. jejuni CG8486
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 139 - protein, 984 aa, Campylobacter jejuni
  Campylobacter jejuni subsp. jejuni HB93-13
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFLKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 140 - protein, 987 aa, Campylobacter jejuni
  Campylobacter jejuni subsp. jejuni LMG 23210
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALVKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 141 - protein, 984 aa, Campylobacter jejuni
  Campylobacter jejuni subsp. jejuni LMG 23211
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALDEHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKISDLQDEKMLEIDHIYPYSRSFDDSYMNKVLVFTKQNQEKLNKTPFEAFGNDGVKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAAIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLVVSKHDNKFETLSKNQKILFKNANEKEVIAKSIGIQNLKVFEKYIVSALGEVTKAEFRQREDFKK

SEQ ID NO: 142 - protein, 984 aa, Campylobacter jejuni
  Campylobacter jejuni subsp. jejuni LMG 23263
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIVKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAEFECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 143 - protein, 984 aa, Campylobacter jejuni
  Campylobacter jejuni subsp. jejuni LMG 23264
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSNDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 144 - protein, 987 aa, Campylobacter jejuni
  Campylobacter jejuni subsp. jejuni LMG 23269
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFHQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 145 - protein, 987 aa, Campylobacter jejuni
  Campylobacter jejuni subsp. jejuni LMG 23357
MARILAFDIGISSIGWAFSENDELKDCGVRIFTKAENPKTGESLALPRCLARSARKRLARRKARLNHLKHLIANEFKLNYEDYQSFDESLAKAYKGSLISPYELRFRALNELLSKQDFARVILHIAKRRGYDDIKNNGDEEKGEILKAIKQNEEKLVSYQSVGEYLYKEYFQKFKENSKEFINVRNKKESYERCIAQSFLKDELKLIFQKQRKFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSNDYEFKGEKGTYFIEFQKYKEFVKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNKTPFETFGNDRVKWQKIEVLAKNLPTKKQKRILDKNYKDKEQKDFKDRNLNDTRYIARLVLNYTKDYLDFLPLSDDENTKLNDTQKGSKVHVEAKSGMLTSTLRHTWGFSTKDRNNHLHHAIDAAIIAYANNSIVKAFSDFKKEQESNTAELYAKKISELDYKNKRKFFEPFSGFRQKLLDKIDEIFVSKPERKKPSGALHEETFRKEEEFYQSYGGKEGVLKALELGKIRKVNGKIVSNGDMFRVDIFKHKKTNKFYAVPIYTMDFALKVLPNKAVVQGKDKKSGLIKDWILMDENYEFCFSLYKDSLILIQTKDMQEPELVYYERLDSSNASLTVSKHDNKFETLSKNQKILFKNANEKEVIAKSIGIQNLKVFEKYIVSALGEVTKAEFRQREDFKK

SEQ ID NO: 146 - protein, 984 aa, Campylobacter jejuni
  Campylobacter jejuni subsp. jejuni NCTC 11168 = ATCC 700819
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 147 - protein, 983 aa, Campylobacter jejuni
  Campylobacter jejuni subsp. jejuni NW
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 148 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYPVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 149 - protein, 1003 aa, Campylobacter lari
MRILGFDIGINSIGWAFVENDELKDCGVRIFTKAENPKNKESLALPRRNARSSRRRLKRRKARLIAIKRILAKELKLNYKDYVAADGELPKAYEGSLASVYELRYKALTQNLETKDLARVILHIAKHRGYMNKNEKKSNDAKKGKILSALKNNALKLENYQSVGEYFYKEFFQKYKKNTKNFIKIRNTKDNYNNCVLSSDLEKELKLILEKQKEFGYNYSEDFINEILKVAFFQRPLKDFSHLVGACTFFEEEKRACKNSYSAWEFVALTKIINEIKSLEKISGEIVPTQTINEVLNLILDKGSITYKKFRSCINLHESISFKSLKYDKENAENAKLIDFRKLVEFKKALGVHSLSRQELDQISTHITLIKDNVKLKTVLEKYNLSNEQINNLLEIEFNDYINLSFKALGMILPLMREGKRYDEACEIANLKPKTVDEKKDFLPAFCDSIFAHELSNPVVNRAISEYRKVLNALLKKYGKVHKIHLELARDVGLSKKAREKIEKEQKENQAVNAWALKECENIGLKASAKNILKLKLWKEQKEICIYSGNKISIEHLKDEKALEVDHIYPYSRSFDDSFINKVLVFTKENQEKLNKTPFEAFGKNIEKWSKIQTLAQNLPYKKKNKILDENFKDKQQEDFISRNLNDTRYIATLIAKYTKEYLNFLLLSENENANLKSGEKGSKIHVQTISGMLTSVLRHTWGFDKKDRNNHLHHALDAIIVAYSTNSIIKAFSDFRKNQELLKARFYAKELTSDNYKHQVKFFEPFKSFREKILSKIDEIFVSKPPRKRARRALHKDTFHSENKIIDKCSYNSKEGLQIALSCGRVRKIGTKYVENDTIVRVDIFKKQNKFYAIPIYAMDFALGILPNKIVITGKDKNNNPKQWQTIDESYEFCFSLYKNDLILLQKKNMQEPEFAYYNDFSISTSSICVEKHDNKFENLTSNQKLLFSNAKEGSVKVESLGIQNLKVFEKYIITPLGDKIKADFQPRENISLKTSKKYGLR

SEQ ID NO: 150 - protein, 1430 aa, Capnocytophaga canimorsus
MKHILGLDLGTNSIGWAVVKEAQNDNEQSEIVDVGVRVNPLTTDEKTNFEKGKPISTNADRTLKRSARRNLQRYKLRRKELIELLKEHQLISTDTILTENGKGTTFQTLELRAKSAKEKISLEELARVFLTINKKRGYKSSRKAKNEDEGQLIDGMEIAKRLYEENLTTGQLSLQLLKEGKKSLPDYYRSDLQFELDKVWNFQKQFHSHILTDEFYAQLKGKGQRATSALFLAKYQIYTAENKGSREDKKLQAYQWRVDALSKELTREQLAFVITEINNNLNNSSGYLGAISDRSKELYFNNETVGEYLWKQIAANPHTSLKNQVFYRQDYLDEFEQIWKTQSAFYPEILTDELKKELRDVVIFYQRKLKSQKSLVSFCEFENKEIEIKKEDGTSTKKVIGLKVAPKSSPLFQEFKIWQNLNNVLIRKKGSKTKKVDKNQQAVLFEEEKTIFELDLEAKQALFNELNLKGNLKAYYCLEILGYSPKEWEMNYSVLEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRVLKDSLEVLKKNSLRQPVVEKILNQMINLVNALLKKYRTENPNFKFDEIRIELARELKKNAEERANMTVNINKAKTEHEKIIKILKNEFGLPNPTRNDIIRYRLYEELKANGYKDLYTNEYIEKQDLFTKNIDIEHIIPKSRVFDDSFSNKTLSFRKTNLDKGERTAFDYIESKFGADKLEEYVARVEDLYKNNIISKAKYQKLLKKESEIGDGFVERDLRETQYIAKKAKEILLQITPNVLSTSGGITDRLREDWDLINVMKELNLPKYRALGLTQMEDRKYGQQVEVIIDWTKRNDHRHHAMDALTVAFTKHNHIQYLNYLNARKNEKHREHSNIMGIQQLETIKVTDKNGNEKRVFKAPMPNFRQVTKAFLENVLISHKAKNKVVTKNKNKVAGSNKVQEVLTPRGQLHKETVYGKYQYYVQKEEKIGGKFDLETIKKVANPLYQSLLKKRLEENGGDPKKAFTGKNSLAKNPIYLDDAQTEQLPEKVKLVWLENSFSIRKDITPENFKDEKLIDKILDEGVKRILKERLQSFGNDAKKAFSDLDKNPIWLNKEKGIAIKRVAISGVANAEPLHTKKDHLGKEILDKEGKSIPVDFISTGNNHHVAVYRDEKGNLQEKVVSVFEAVVRANQGLPIIDKTYNQHLGWEFLFTMKQNEMFVFSNESTGFNPNDIDLLDPKNKKIISPNLFRVQKFSKLQYGNSFVREFVFRHHLETTVEDRKELQGITYKQMKNSAFFNDIIKVRINHLGGIVSVGEY

SEQ ID NO: 151 - protein, 1436 aa, Capnocytophaga gingivalis
  Capnocytophaga gingivalis ATCC 33624
MKYIKYILGLDIGSNSIGWALIQLDLLQKTKRIIAAGSRIIPMDQKVLSDFGKGITISPTAQRTSYRNARHCRERHLLRRERLHRVLHILGFLPTHYDKQIDFSKRYGKFVDNTEPKIAYNEGKFLFMDSFQEMLSDFKSHQPDLFYTKKNGEESKIPYDWTIYYLRKKALSQKISKEELAWIILNFNQKRGYYQLREEEGNKENDFEIISSKIISVIKKDKDKKYNKYWYDIILENGLVYQAAFYNDFVYNWINQDREFIIERTSLKNGAEKVKLSYLPTFDEIDKMDKKEQDKYYKKIKIKTENSIGNKTVGCYIYDHILQNPNEKIKGKLVRTIERKYYKEELKAILEKQIALQPELFTDQLLADCIRELYSKNEAQQRNLAARDFVHLLVEDIIFYQRPLRRQKSTLANCSLESRSYIDKDSHTRKEAPLKVCPKSNPYYQEFRVLQWLQNLKIYEIDSDQEVTHQFIKTLEDKQQLFEFLMAQKEIDCEELLKYFLNQTYPNAKEKALKSELKKWKDTYRWNYVYDIGEKSSKKYPMNETRYELKRHLEKVANLPDDFLSSEVEYLLWHLIYSVKDKVAYEKGLKKFAQKHHLDKDSFVESFKKFNPYPSEYGSFSEKAIRKLLPLMRFGAHWDFNHIDKNTQKRIEDLITGVENEEIRTILREKAEKYQLEKETDFQDLPLWLAQYIVYNRHAEASSLEKWTSVNDLETYLNEFKQHSLRNPIVEQVVMETLRVVRDIWQQYGQGQASFFNEIHIELGRELKKTAKEREKLSKQNQKNEDINLSIKEKLKELEKYNTRAYSITHQEKYKLWLEQKHISPYTGQIISPENLFTDNYEIEHIIPQSRFFDDSLSNKVVCESIVNKAPYKDRQLGLEFIKNQGGRIVKELSKENKTIKIFTEEQYRTFIKEHYSNNPEKTKKLLLEEIPEKMVARQMNDTCYISKFISEILSKIVRSDEQDEGVHSKNVILCTGKITSILRQDWGLNDIWDNLILPRFERMNNLLQKEKFTIYSIEKQKKIPVVPINDQFKSFQKKRIDHRHHAMDAIIIACTTREHINYINNQHALEKEKDKKEKQEERDKLREKLCIKKYNNRSEGNYSWIFKKPWDTFTQEVRVALEDIVVSFKQNLRVINKATNYYERWVEENGKYIKKMVKQEGTNWAIRKPLHEETISGKIYLDREKITKNDILTATRKTVDSSFDDKRIKKITDTGIQKILLNYLKYKGSPEIAFSPEGLEELNKNLSIYNDGKPHKPIYKVRIYEKGSGRFALGEKGRKYKKYVQGASNLYFGIYQGAKRSFATIPLNEVIERQKQGLPSVPEYNEKGDLLLFSLSPNDLVYVPIEGEIIENIDFRNLSKEQKERIYNVNDFSSTCYFTPNRIAKAIFPKEVDLQRKGDKLSGSYDTKTASLEGIQIKEVCIKLKVDRLGNISKA

SEQ ID NO: 152 - protein, 1426 aa, Capnocytophaga ochracea
MKNILGLDLGTTSIGFAHIVEDENKEKSEIKELGVRIVSLTTDEQSDFEKGKSITTNANRTLKHGARLNLDRYQQRRKYLIDLLQKANLITPSSILAENGKNTTHSTWQLRAKAVTERIEKEEFARILLAINKKRGYKSSRKAKTEDEGQAIDGMAIAKRLYDENLTPGQLSLQLLQQNKKLLPDFYRSDLQKEFDLVWNFQKQFYPDILTDIFYKELQGKGKDATSKAFSKRYHFDTTENKGSKESVRLQAYQWRAEAISKQLSKEEVAYVLTEINNNLNNASGYLGAISDRSKELYFNRQTVGQYLYAKLQENRHNSLKNKVFYRQDYLDEFERIWETQASFHKELTDELKKQIRDVVIFYQRKPKSQKGLISFCEFESKEIEIEKDGKTITKNIGARVVPKSSPLFQEFKIWQILNNVICKRKGIRKKKISAKTTQLDLLNESSQTIFSLDMECKQLLFDELNLKGDLKSDKVLKLLGYSPQEWEINYNQLEGNRTQKALYEAYLKIVEMEAHDVKDILQIKSAKDDWSLDESPLSASEIREKVKAIFQTLGICTKILYFDPLLPVKEFEEQDSYQLWHLLYSYESDDSTSGNETLYRILEKKYAFKREHARILANVALQDDYGSLSTKAIRKIYPNIKENQYSTACEKAGYKHSKLSLTTEELEARELKNIIPLLKKNALRNPVVEKILNQMINVVNALIEKNSERDAEGKITKYFHFDEIRIELARELKKNAQKRYEMTQNINKAKLEHQKISEILQKEFGIKNPTKSDIIRYRLYQELEHNGYKELYTNAPIARDMLFSKNIEIEHIVPKARVFDDSFSNKTLTFHRINSDKGEYTAFDYITSLNSEEELNQYLTRVENAYKTKSISPTKYKNLLKKASEIGDDFINRDLRDTQYIAKKAKEILFQVTKNVLSTSGSITDRLREDWGLVDVMKELNMPKYQSLGLTEVEERKDGNKVTVIKNWTKRNDHRHHAMDALTVAFTKPSYIQYLNHLNARKDENNKNYSVILAIEEKETIKVPTNNGKNKRVFIEPIPNFRQVAKKHLEEIFISHKAKNKVVTKNTNKPAGTDKQQITLTPRGQLHKETIYGKYQYYINKEEKIGVKFDERTIAKVSNPVYREALLKRLQANDNDPKKAFAGKNALSKNPIYLDESKTKTLPEKVNLTYLEEDFSIRKDISPDNFKDLKSIEKVIDQGVKRILIKRLQAYDNDPKKAFVDLEKNPIWLNKEKGIAIKRVTISGVNNAQPLHIGKDHLGKTTLNKEGKEIPVDYVSTGNNHHVAIYRDKEGNLQEQIVSFFDAVVRAQQGIPIIDKTYKQAEGWQFLFTMKQNEMFVFPNATTGFNPAEIDLLDPKNKKLISPNLFRVQKIATKDYFFRHHLETNVETDNILKNVTWKREGLSGLKDIVKVRINHLGDIVSIGEY

SEQ ID NO: 153 - protein, 1437 aa, Capnocytophaga sp.
  Capnocytophaga sp. CM59
MKYIKYILGLDIGSNSIGWALIQLDLLQKTKRIIATGSRIIPMDQKVLSDFGKGITISPTAQRTSYRNARHCRERHLLRRERLHRVLHILGFLPTHYDKQIDFSKRYGKFVDNTEPKIAYNERKFLFMDSFQEMLADFKIHQPDLFYTKKNGEESKIPYDWTIYYLRKKALSRKISKEELAWIILNFNQKRGYYQLREEEEENKENDFEIISSKIISVIKKDKDKKYNKYWYDIILENGLVYQAAFYNDFVYNWINQDREFIIERISLKNGTEKVKLSYLPTFDEIDKMDKKEQDKYYKKIKIKTENSIGNKTVGCYIYDHILQNPNEKIKGKLVRTIERKYYKEELKAILEKQVALQPELFTDQLFADCIRELYSKNEAQQRNLAARDFVHLFVEDIIFYQRSLRRQKSTLANCSLESRSYIDKDSHTRKEAPLKVCPKSNPYYQEFRVLQWLQNLKIYEIDTDQEVTHEFIKTLEDKQQFFDFLMNQKEIDCEELLKYFLNQTYPNAREKALKSELKKWKDTYRWNYVYDIGEKSSKKYPMNETRYELKRHLEKVANLPDDFLSSEVEYLLWHLIYSVKDKVAYEKGLKTFAQKHHLDKDSFVESFKKFKPYPSEYGSFSEKAIRKLLPLMRFGSYWDFNHIDKNTQKRIEDLITGVENEEIRTILREKAEKYQLEKETDFQDLPLWLAQYIVYNRHAEASSLEKWTSVNDLETYLNEFKQYSLRNPIVEQVVMETLRVVRDIWQQYGQGQASFFDEIHIELGRELKKTAKEREKLSKQNQKNEDINLSIKEKLKELEKYNTRAYSITHQEKYKLWLEQKHISPYTGQIISPENLFTDNYEIEHIIPQSRFFDDSLSNKVVCESIVNKAPYKDRQLGLEFIKNQGGRIVKELSTENKTIKIFTEEQYRTFIKEHYSNNPEKTKKLLLEEIPEKMVARQMNDTCYISKFISEILSKIVRSDEQDEGVHSKNVILCTGKITSALKQDWGVNDVWNDLILPRFERMNDLTQSTLFTTYNEKYQKYLPTVPMEYSNGFQKKRIDHRHHAMDAIIIACATREHINYINNQHALEKGKDKKEKQKEHDKLREKLCIKKDNKGSEENYSWIFKKPWDTFTQEVQAALEGIVVSFKQNLRVINKATNYYERWVEENGKYIKKMVKQEGTNWAIRKPLHEETISGKIYLDREEITKNDILTATRKTVDSSFDEKRIKKITDTGIQKILLNYLKYKGSPEIAFSPEGLEELNKNLSIYNDGKPHKPIYKVRIYEKGSGRFALGEKGRKYKKYVQGAPNLYFGIYQGANKRSFATIPLNEVIERQKQGRPSIPEYNEKGDPLLFSLSPNDLVYVPVEGEIIEDIDFQNLSKEQKERIYNVNDFSSTCYFTPNRIAKAIFPKEVDLQRKGDKLPGSYDTKTASLEGIQIKEVCIKLKIDRLGNISKA

SEQ ID NO: 154 - protein, 1471 aa, Capnocytophaga sp.
  Capnocytophaga sp. oral taxon 324 str. F0483
MCKYFYIKNFITFVLSKSIIPMKHILGLDLGSNSIGWAFVQQDFENKQGKIIATGSRIIPMDQGILGDFERGNTVSQTAERTTYRSTRRLRERHLLRRERLHRVLHILGFLPPHYDAQIDFTKRYGKFIDNAEPKIAYNNGNFIFMNSFNEMIEDFKKHQPQLFYKKSNGEESKIPYDWTIYYLRKKALSQKITQQELAWLILHFNQKRGYYQLRGEEETENPNKEVAFHSLKVVDVEAEAPNKKGEIWYTIRLENGWIYRRTSKIPLDDWKGKTRDFIVTTDLNDDGTIKVDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDAPIKVCAKSNPYYQEFRVLQWLQNLRIYEIETDREVTAEFIETPQDCEALFNFLMSQKEIDNKGLLKYFLFAKNPQIKDKAAKSELKKWLTTYRWNYVYDAADNSSKKYPMNETGYELQRYLQKVEGLPANFLTFDITYQLWHLLYSVKDKVEFEKALKKFAKKKQLDKTSFVDSFKNFKPYPNEYGSFSEKAIKKLLPLMRFGNHWDFNRIDVSTQKRIDDLINGVANEDIRTIIREKAEKYQLNSETCFQDLPLWLAQYVVYNRHAEATDIEKWTSVSDLEAYLEDFKQHSLRNPIVEQVVTETLRVVRDIWQQYGGGQANFFDEIHIELGRELKKTAEERKQLSDKNQENESTNLRIKKLLAELKEDASIQNVRPYSLVQQELLKIYEEGVFSATDEVEEDIQKIRKKAEPSKADLQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKYISEILSKIVRSDEKDEGVNSKNIIPCTGKITTALKQDWGLNDVWNKLILPRFERMNQLTQTQLFTSYNDRLQKNLPTVPIEYSQGFQKKRIDHRHHAMDALVIACATREHINYMNNQHALDKSKDKKEKQQSRIDLRTILCEKKNNNWQFKKPWSTFTQEAKEALEHIVVSFKQNLRVINKATNYYEKWEEKNGVLVKKKVKQEGTNWAIRKPLHKETVSGKIVLDRKIGKDKILTATRKAVDITFTEKIISSITDTGIQKILLNYLKYKGSPEVAFSTEGLEELNKNIAQYNNGKKHQPIYKVRIFEEGSKFPLGETGAKATKYVEAAKGTNLFFGVYQGKGKRTYATIPLNEVIERQKQGLPSVPERNEKGEPLLFSLSPNDLVYVPMEGEIAETIDFNNLSKEQKERIYKTVSFTGNQCFFVQEAVATPIVNKMEYSPLNKMERDILGTMIKEVCIKLKVDRLGNITKA

SEQ ID NO: 155 - protein, 1450 aa, Capnocytophaga sp.
  Capnocytophaga sp. oral taxon 326 str. F0382
MKRILGLDLGSNSIGWAFVEQDFENKQGKIIATGSRIIPMDQGILGDFEKGNTVSQTAERTTYRSMRRLRERHLLRRERLHRVLHILGFLPPHYDAQIDFTKRYGKFIDNAEPKIAYNNGNFIFMNSFNEMIEDFKKYQPQLFYKKSNGEESKIPYDWTIYYLRKKVLSQKITQQELAWLILHFNQKRGYYQLRGEEETENPNKEVAFHSLKVVDVEAEAPNKKGEIWYTIRLENGWIYRRTSKIPLDDWKGKTRDFIVTTDLNDDGTIKVDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDTFIKVCAKSNPYYQEFRVLQWLQNLRIYEIETDREVTAEFIETAEDYEALFNFLMSQKEIDNEGLLKYFLFAKNPQIKDKVAKSELKKWLTTYRWNYVYDAADNSSKKYPMNETGYDLQRYLQKVEGLPANFLTFDITYRLWHLLYSVKDKVEFEKALKKFAQEYQLDEASFVDSFKNFKPYPNEYGSFSEKAIKKLLPLMRFGNHWDFNRIDVSTQKRIDDLINGVANDEIRTIIREKAEKYQLNSESCFQGLPLWLAQYVVYNRHAEATDIEKWTSVSDLETYLEDFKQHSLRNPIVEQVVTETLRVVRDIWQQYGGGQANFFDEIHIELGRELKKTAEERKQLSNRNQENENTNLRIKKLLAELKEDASIQNVRPYSPVQQELLKIYEEGVFSSTDQVEEDIQKIRKKAEPTTPEIQRYKLWLEQKYKSPYTGEVISLTKLFTEEYEIEHIIPQSRYYDDSLSNKVICESAVNKLKTNQLGLEFIQNHHGEKVRITGNKEVTIFTEEQYKEFVKKHYANNSAKQQKLLLNEIPEKMVARQLNDTRYISKYISEILSKIVRSDEKDEGVNSKNVIPCTGKITTALKQDWGLNDVWNELILPRFERMNQLTQTQLFTSYNDRFQKNLPTVPIEYSQGFQKKRIDHRHHAMDALVIACATREHINYMNNQHALDKNKDKKEKQQSRIDLRTILCEKKNNNWQFKKPWSTFTQETKEALEHIVVSFKQNLRVINKATNYYEKWEEKNGVLVKKKVKQEGTNWAIRKPLHKETVSGKIVLDRKIGKDKILTATRKEVDITFTEKIISSITDTGIQKILLNYLNYKGSPEVAFSAEGLEELNKNIAQYNDGKKHQPIYKVRIFEEGSKFPLGETGAKATKFVEAAKGTNLFFGVYQGKEKRSYATIPLNEVIERQKQGLPSVPERNEKGEPLLFSLSPNDLVYVPMEGEIAETIDFNNLSKEQKERIYKTVSFTGNQCFFVQEAVATPIVNKMEYSPLNKMERDILGTMIKEVCIKLKVDRLGNITKA

SEQ ID NO: 156 - protein, 1435 aa, Capnocytophaga sp.
  Capnocytophaga sp. oral taxon 329 str. F0087
MKNILGLDLGTTSIGFAHIVEDENKEKSEIKELGVRIVSLATDEQSDFEKGKSISTNANRTLKHGARLNLDRYQQRRKFLIDLLQKANLITSASILAENGKNTTHSTWQLRAKAVTERIEKEEFARVLLAINKKRGYKNSRKTKTEDEGQAIDGMAIAKCLYDENLTPGQLSLQLLQQNKKLLPDFYRSDLQKEFDLVWNLQKQFYPDILTDSFYKELQGKGKDATSKAFSKRYHFDTAENKGSKESVRLQAYQWRAEAISKQLSKEEVAYVLTEINNNLNNSSGYLGAISDRSKELYFNRQTVGQYLYAQLQENRHNSLKNKVFYRQDYLDEFERIWETQASFHKELTDELKKQIRDVVIFYQRKLKSQKGLVSFCEFESKEIEIEKDGKAITKSIGARVVPKSSPLFQEFKIWQILNNVTCKRKGIRKKKSSAKSTELDLFNEPSQSIFSLDMECKQLLFDELNLKGDLKSDKVLKLLGYSPQEWEINYNQLEGNRTQKSLYEAYLKIIEIEGYEVKDILQIKSTKDDWSLDESPLSASEIRERVKVIFQTLGICTKILYFDPLLPVKEFEQQYSYQLWHLLYSYESDDSTSGNETLYRILEKKYAFKREHATILANVALQDDYGSLSTKAIRKIYPYIKENQYSTACELAGYKHSKLSLTTEELEARELKNIIPLLKKNALRNPVVEKILNQMINVVNALIEKNSERDAEGKITKYFHFDEIRIELARELKKNAQERYEMTQNINKAKLEHQKISEKLQKQFGIKNPTKSDIIRYRLYQELEHNGYKELYTNTYIAPDVLFSKNIDIEHIVPKARVFDDSFSNKTLAFKEFNIKKGESTAFDYITSLNCEGELNQYLTRVENAYKTKSISLTKYKNLLKKASEIGDGFINRDLRDTQYIAKKAKEILFQVTKNVLSTSGSITDRLREDWGLVDVMKELNMPKYQSLGLTEVEERKDGNKVTVIKDWTKRNDHRHHAMDALTVAFTKPSYIQYLNHLNARKDENNKNYSVILAIEKKETIKVPINNGKNKRVFIEPILNFRQVAKKHLEEIFISHKAKNKVVTKNINKPAGTDKQQITLTPRGQLHKETIYGKYQYYVNKEEKVGVKFDERTITKVSNPLYREALLKRLQANDNDPKKAFAGKNALSKNPIYLDEAKTKTLPEKVNLTYLEEDFSIRKDISPDNFKDLKSIEKVIDQGVKRILIKRLQAYDNDPKKAFVDLEKNPIWLNKEKGIAIKRVTISGVSNAQPLHIGKDHLGKTTLNKEGKEVPVDYVSTGNNHHVAIYRDKEGNLQEQIVSFFEAVVRAQQGLPIIDKNYKQAEGWQFMFTMKQNEMFVFPNEATGFNPAEIDLLDPKNKKLISPNLFRVQTISIVKYGNSVVRDFKFRHHLETTLQDDKILQGITFQQIKSLEPLRNIVKVRINHLGDIVNIGEY

SEQ ID NO: 157 - protein, 1426 aa, Capnocytophaga sp.
  Capnocytophaga sp. oral taxon 335 str. F0486
MKNILGLDLGTTSIGFTHIVEDENKEKSEIKELGVRIVSLTTDEQSDFEKGKSISTNANRTLKHGARLNLDRYQQRRKFLIDLLQKANLITSSSILAENGKNTTHSTWQLRAKAVTERIEKEEFARVLLAINKKRGYKSSRKAKTEDEGQAIDGMAIAKRLYDENLTPGQLSLQLLQQNKKLLPDFYRSDLQKEFDLVWNFQKQFYPDILTDSFYKELQGKGKDATSKAFSKRYHFDTAENKGSRESVRLQAYQWRAEAISKQLSKEEVAYVLTEINNNLNNASGYLGAISDRSKELYFNRQTVGQYLYAQLQENKHNSLKNKVFYRQDYLDEFERIWETQASFHKELTEELKKQIRDVVIFYQRKLKSQKGLISFCEFESKEIEIEKDGKTITKSIGARVVPKSSPLFQEFKIWQILNNVTCKRKGIRKKKSSAKSTELDLFNEPSQTIFSLDMECKQLLFEELNLKGDLKSDKVLKLLGYSPQEWEINYNQLEGNRTQKALYEAYLKIVEMEAHDVKDILQIKSTKDDWALEESPLSASEIRERVKAIFQTLGICTKILYFDPLLPVKEFEEQDSYQLWHLLYSYESDDSTSGNETLYRILEKKYAFKREHATILANVTLQDDYGSLSTKAIRKIYPYIKENQYSTACEKAGYKHSKLSLTTEELEARELKNIIPLLKKNALRNPVVEKILNQMINVVNALIEKNSERDAEGKITKYFHFDEIRIELARELKKNAQERYEMTQNINKAKLEHQKISGILQKEFGIKNPTKSDITRYRLYQELAHNGYNDLYTNTYIPKELLFSKNIDIEHIVSKARVFDDSFSNKTLAFREFNIKKGESTAFDYITSLNNEEELNQYLNRVENAYKTKNISPAKYKNLLKKASEIGDGFINRDLRDTQYIAKKAKEILFQVTKNVLSTSGSITDRLREDWGLVDVMKELNMPKYQSLGLTEVEERKEGNKVTVIKNWTKRNDHRHHAMDALTVAFTKPSYIQYLNHLNARKDKNNKNYSVILAIEEKETIKVPTNNGKNKRVFIEPIPNFRQVAKKHLEEIFISHKAKNKVVTKNTNKPAGTDKQQITLTPRGQLHKETVYGKYQYYVNKEEKIGVKFDKETIAKVSNPVYREALLKRLQANDNDPKKAFAGKNALSKNPIYLDEAKTKTLTEKVNLTYLEEDFSIRKDISPDNFKDLKSIEKVIDQGVKRILIKRLQDYDNDPKKAFVDLEKNPIWLNKEKGIAIKRVTISGVNNAQPLHIGKDHLGKTTLNKEGKEIPVDYVSTGNNHHVAIYRDKEGNLQEQIVSFFEAVVGAQQGLPIVDKTYKQAEGWQFLFTMKQNEMFVFPNEATGFNPAEIDLLDPKNKKQISPNLFRVQKIATKDYFFRHHLETNVDTDNVLKNTTWKREGLSGLKDIVKVRINHLGDIVSIGEY

SEQ ID NO: 158 - protein, 1432 aa, Capnocytophaga sp.
  Capnocytophaga sp. oral taxon 380 str. F0488
MKNILGLDLGTTSIGFAHIVEDENKEKSEIKELGVRIVSLTTDEQSDFEKGKSITTNANRTLKHGARLNLDRYQQRRKYLIDLLHKANLITPSSILAENGKNTTHSTWQLRAKAVTERIEKEEFARILLAINKKRGYKSSRKAKTEDEGQAIDGMAIAKRLYDENLTPGQLSLQLLQQNKKLLPDFYRSDLQKEFDLVWNFQKQFYPDILTDIFYKELQGKGKDATSKAFSKRYHFDTAENKGSKESVRLQAYQWRAEAVSKQLSKEEVAYVLTEINNNLNNASGYLGAISDRSKELYFNRQTVGQYLYAQLQENRHNSLKNKVFYRQDYLDEFERIWETQALFHKELTDELKKQIRDVVIFYQRKPKSQKGLISFCEFESKEIEIEKDGKTITKNIGARVVPKSSPLFQEFKIWQILNNVICKRKGIRKKKISAKTTQLDLLNESSQTIFSLDMECKQLLFDELNLKGDLKSDKVLKLLGYSPQEWEINYNQLEGNRTQKALYEAYLKIVEMEAHDVKDILQIKSTKDDWSLDESPLSASEIRESVKAIFQALGICTKILYFDPLLPVKDFEEQDSYQLWHLLYSYESDDSTSGNETLYRILEKKYAFKREHARILANVALQDDYGSLSTKAIRKIYPNIKENQYSTACEMAGYKHSKLSLTTEELEARELKNIIPLLKKNALRNPVVEKILNQMINVVNALIEKNSERDAEGKITKYFHFDEIRIELARELKKNAQKRYEMTQNINKAKSEHQKISEILQKEFGIKNPTKSDIIRYRLYKELEHNGYKELYTNTYIAPDVLFSKNIDIEHIVPKARVFDDSFSNKTLAFKDFNIKKGESTAFDYITSLKNEEKLNQYLARVENAYKTKNISPAKYKNLLKKASEIGDGFINRDLRDTQYIAKKAKEILFQVTKNVLSTSGSITDRLREDWSLVDVMKELNMPKYQSLGLTEVEERKDGNKVTVIKDWTKRNDHRHHAMDALTVAFTKPSYIQYLNHLNARKDENNKNYSVILAIEKKETIKVPTNNGKNKRVFIEPIPNFRQVAKKHLEEIFISHKAKNKVVTKNTNKPAGTNKQQITLTPRGQLHKETIYGKYQYYVNKEEKVGVKFDKETIAKVSNPLYREALLKRLQANDNDPKKAFTGKNALSKNPIYLDEAKTKTLPEKVNLTYLEEDFSVRKKIVPKNPTSKEFVPNLKSIEKVVDEGVRNILIERLRVYNNDPEKAFVDLEKNPIWLNKEKGIAIKRVTISGVNNAQPLHIGKDHLGKTTLNKEGKEIPVDYVSTGNNHHVAIYRDKEGNLQEQIVSFFEAVVRTQQGLPIIDKTYKQEEGWQFLFTMKQNEMFVFPNEATGFNPAEIDLLDPKNKKQISPNLFRVQKIATKDYFFRHHLETNVETDNVLKNTTWKREGLSGLKDIVKVRINHLGDIVSIGEY

SEQ ID NO: 159 - protein, 1450 aa, Capnocytophaga sp.
  Capnocytophaga sp. oral taxon 412 str. F0487
MKHILGLDLGSNSIGWAFVQQDFENKQGKIIATGSRIIPMDQGILGDFERGNTVSQTAERTTYRNTRRLRERHLLRRERLHRVLHILGFLPPHYDSQIDFTKRYGKFIDNAEPKIAYNNGNFIFMNSFNEMIEDFKKYQPQLFYKKSNGEESKIPYDWTIYYLRKKALSQKITQQELAWLILHFNQKRGYYQLRGEEETENPNKEVAFHSLEVVDVEAEAPNKKGEIWYTIRLENGWIYRRTSKIPLDDWKGKTRDFIVTTDLNDDGTIKLDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDTPIKVCAKSNPYYQEFRVLQWLQNLRIYEIETDREVTAEFIETAQDNEALFNFLMSQKEIDNESLLKYFLFAKNPQIKDKVAKSELKKWLTTYRWNYVYDAADNSSKKYPMNETGYELQQYLQKVEGLPANFLTFDITYRLWHLLYSVKDKVEFEKALKKFAQEYQLDEASFVDSFKNFKPYPNEYGSFSEKAIKKLLPLMRFGNHWDFNRIDVSTQKRIDDLINGVANDEIRTIIREKAEKYQLNSETCFQGLPLWLAQYVVYNRHAEAADIEKWTSVNDLEAYLEDFKQHSLRNPIVEQVITETLRVVRDIWQRYGGGQANFFDEIHIELGRELKKTAEERKQLSNRNQENENTNLRIKKLLAELKEDASIQNVRPYSPVQQELLKIYEEGVFSATDEVEEDIQKIRKKAEPTTPEIQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKYISEILSKIVRSDEKDEGVNSKNIIPCTGKITTALKQDWGLNDVWNELILPRFERMNQLTQTQLFTSYNDRFQKNLPTVPIEYSQGFQKKRIDHRHHAMDALVIACATREHINYMNNQHALDKSKDKKEKQQSRIDLRTILCEKKNNNWQFKKPWSTFTQEAQEALEHIVVSFKQNLRVINKATNYYEKWEEKNGVLVKKKVKQEGTNWAIRKPLHKETVSGKIVLDRKIGKDKILTATRKSVDITFTEKIISSITDTGIQKILLNYLKYKGSPEVAFSAEGLEELNKNIAQYNDGKKHQPIYKVRIFEEGSKFPLGETGAKATKYVEAAKGTNLFFGVYQGKGKRTYATIPLNEVIERQKQGLPSVPERNEKGEPLLFSLSPNDLVYVPMEGEIAETIDFNNLSKEQKERIYKTVSFTGNQCFFVQEAVATPIVNKIEYSPLNKMERDILGTMIKEVCIKLKVDRLGNITKA

SEQ ID NO: 160 - protein, 1426 aa, Capnocytophaga sputigena
  Capnocytophaga sputigena ATCC 33612
MKNILGLDLGITSISFAHIVEDENKEKSEIKELGVRIVSLTTDEQSDFEKGKSITTNANRTLKHGARLNLDRYQQRRKYLIDLLQKANLITSSSILAENGKNTTHSTWQLRAKAVTERIEKEEFARVLLAINKKRGYKSSRKAKTEDEGQAIDGMAIAKRLYDENLTPGQLSLQLLQQNKKLLPDFYRSDLQREFDLVWNFQKQFYPDILTDSFYKELQGKGKDATSKAFSKRYHFDTAENKGSKESVRLQAYQWRAEAISKQLSKEEVAYVLTEINNNLNNASGYLGAISDRSKELYFNRQTVGQYLYAQLQENRHNSLKNKVFYRQDYLDEFERIWETQASFHKELTDELKKQIRDVVIFYQRKLKSQKGLISFCEFESKEIEIEKDGKTITKTIGARVVPKSSPLFQEFKIWQILNNVTCKRKGIRKKKSSAKSTELDLFNEPSQTIFSLDMECKQLLFDELNLKGDLKSDKVLKLLGYSPQEWEINYNQLEGNRTQKALYEAYLKIVEMEAHDVKDILQIKSAKDDWSLDESPLSASEIKEKVKDIFQALGICTKILYFDPLLPVKEFEKQDSYQLWHLLYSYESDDSTSGNETLYRILEKKYAFKREHARILANVALQDDYGSLSTKAIRKIYPNIKENQYSKACELAGYKHSKLSLTTEELEARELKNIIPLLKKNALRNPVVEKILNQMINVVNALIEKNSERDAEGKITKYFHFDEIRIELARELKKNAQKRYEMTQNINKAKLEHQKISEILQKKFGIKNPTKSDIIRYRLYQELEHNGYKELYTNAPIARDMLFSKNIEIEHIVPKARVFDDSFSNKTLTFHRINSNKGEYTAFDYITSLNSEEELNQYLTRVENAYKTKSISLTKYKNLLKKASEIGDGFINRDLRDTQYIAKKAKEILFQVTKNVLSTSGSITDRLREDWGLVDVMKELNMPKYQSLGLTEVEERKEGNKVTVIKNWTKRNDHRHHAMDALTVAFTKPSYIQYLNHLNARKDENNKNYSVILAIEEKETIKVPTNNGKNKRVFIEPIPNFRQVAKKHLEEIFISHKAKNKVVTKNVNKPAGTDKQQITLTPRGQLHKETIYGKYQYYVNKEEKVGVKFDERTITKVSNPLYREALLKRLQANDNDPKKAFTGKNALSKNPIYLDETKTKTLPEKVNLTYLEEDFSIRKDISPDNFKDLKSIEKVIDQGVKRILIKRLQDYDNDPKKAFVDLEKNPIWLNKEKGIAIKRVTISGVSNAQPLHIGKDHLGKTTLNKEGNEIPVDYVSTGNNHHVAIYRDKEGNLQEQIVSFFEAVVRTQQGLPIIDKTYKQEEGWQFLFTMKQNEMFVFPNATTGFNPAEIDLLDPKNKKLISPNLFRVQKIATKDYFFRHHLETNVETDNVLKNTTWKREGLSGLKDIVKVRINHLGDIVSIGEY

SEQ ID NO: 161 - protein, 1140 aa, Catellicoccus marimammalium
  Catellicoccus marimammalium M35/04/3
MKNMTKVNVGLDVGISSAGWSVINAETNQILESGVRLFSGSDADENVNRRNQRQGRRLFRRRKLRIQEAKKYLENVFQLKDIEPKDEWNPYEIRVRALNEKVSKEELSIALLNIVKHRGISYELEDVTDEEGTNTQSFQSGLDYNRRLLKTKTVGEIQYDRLQKYGQVRGQIQTEDGLLINIFPTKNYVEEVERILETQKKYHPEIDDVFIEKIISFVTRKREYFVGPGNEKSRTDYGIYRENGETLDNLFEILIGKDKFYPEEYRAAGSSYTAQIFNLLNDLNNLRIPTTEDHHLTKAQKEEIITELKNTSRLSGGMLKLISKVTKAPKEEISGYRKDEKDKPDLHSLAYYRKQKNMLEKEGIQIADFSEELLDELATMMTLNTEPGEIRKQLNKITNQYDILTPEVIEVLVKNHTAFVATSNHKWHRFSLKLMKEFIPELLETSKEQSTILCERGFIQNRASYLDENHHFNYAELRENLYNPVVRKSTCEMLKVFTAIQEKYPNIQNVIVELPRETNEDEQKRKIKKINDNNAKRKKEILKEAQAQSGLSEEALEEKLLKTKGLYLKLMLWYEQEGKCVYSGQEIPLSDLLQNKGGYEVDHIIPISISFDDRLCNKVLVRQQLNSQKSNQTPFEYMTTHTDGHLSFHELKELVGKNKRFSKEKRELLLAEIYSNDIETRKRFINRNLVDTSYTARIVLNALQQYKKENQLSMNVSVVRGAMTNILRKKVKLDKTRETFHHHAIDASLMAVIPNIEFFKERKEWLPKSANEEVVEVEVSEEETMPEKEFKVKMRLPESFIQDVQILQRNSFAKEEVSGPQTRERNLKIKFSHQVDQKMNRKVADDTIYGTRQAQLGKDKKEETYVIGKIKDIYNYDEYVRFKKRYDKNKESFLMYHHDPQTFEKLEEILAQYPEYIEDEKGKKKKVSPFALYREENGPVTKYAKKNNGPVIKQLKYYDSKLNRKIDISHKYSTKNRQVVLQSLKPYRTDVYRNQDTGEYTLVGIDQNDGKFVNGHYGIPKSRYEEIKANNKLSEHDEFVFSLYKNSMVKVIDENGESIVVRYLSRSMPNRKNNAEIKPVEKYQFEDGEVVPVYGKCRKQMQTVFVKKGWTLLKGNTDILGNTYFVEKESENPKKMIDDK

SEQ ID NO: 162 - protein, 1329 aa, Catenibacterium mitsuokai
  Catenibacterium mitsuokai DSM 15897
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 163 - protein, 1419 aa, Chryseobacterium sp.
  Chryseobacterium sp. CF314
MMIKNILGLDLGTNSIGWALIKQNFENKYGEILGMGSRIIPMSQDVLGEFGKGNSVSQTAARTGYRGVRRLRERFLLRRERLHRVLNVLNFLPEHYASQIDFEKRFGKFKYETEPKLAYNNDGFFFKNSFDEMLGDFKDHQFHLLENGRKVPYDWTIYYLRKKALSQKIEKEELAWILLNFNQKRGYYQLRGEDFEEEKDRVFVRLKVDRVVDSGENIKGKILYDVYFENGWKYEKQIVKTEDWIGRTKEFIVTESILKNGDTKRTFKAVDSEKDWIAIKTKTEQEIDKSHKTVGAYIYEALLQNPKQKIKGKLVRTIERKFYREELKKILERQKEFHPELQSDDLYNDCIRELYRNNEAHQITLSKKDFVHLLLNDLIFYQRPLRSQKSSVSNCTLEFRKYKDENGVEHAQYLKTIPKSNPYYQEFRVWQWMFNLNIYRKDDDTNVTKEFLSSTEDYETLFEFLNNRKEVDQKALLRHFKLNEKTHRWNYVEDKKYPCNETKTMISTRLEKVENYPSDFLTREMEQNIWHIIYSVNDKIEYEKALKSFAHKNNLDENSFFEAFKKFPPFKSEYGSFSEKAIKKLLPLLRLGKYWNWESIDRKSQGRIEKIITGEFDGNIKDKVREKAIHLTAENDFQGLQLWLAQYIVYGRHSEASMIGKWNSADDLEEFLKGFKQHSLRNPIVEQVITETLRVVKDIWLKYGNGAKDFFSEIHIELGREMKQTKDERVDATKRITENENTNLRIKALLAEMMNDNSVENIRPYSPMQQEILKIYEDGILKSDIEIDDDILKISKTAQPSSSDLKRYKLWLEQRYKSPYTGQIIPLNKLFTSEYEIEHIIPQSRYFDDSFSNKIICESAVNKLKDNYIGLGFIKQFGGMIVECGFGKSVEIFKAEEYEDFVKKHYANNRSKRNKLLLEEIPEKMIDRQLNDTRHISKYISGVLSNIVRQEDGTDEGVNSKNIVPGNGKITTQLKQDWGLNDVWNELILPRFERMNQLTNSTDFTSWNKNHQKFLPTVPIEFSKGFSKKRIDHRHHAMDALVIACATKDHINLLNNQSAKSDTKRYDLKRKLMKFERVVYSHSKTGEKIEKEVPKQFLKPWDNFTVDAKNKMETIIVSFKQNLRVINKATNHYEKWIEKDGIKRKELIKQEGTNWAIRKPMHKETVSGKVDLPGIKIPKGKILTATRKSLDTSFDLKTINSITDTGIQKILKNYLEFKGSSELAFSPEGIEDMNKNIEKFNDGKPHQSINKVRIFELGSKFSVGQTGNKKDKYVEAAKGTNLFFAVYEDKNGKRSYETIPLNEVIERQKQGLDSVSFKNKEDFLLCPNDLVYVPSEDELENIYNIDFKNLTTEKTGNIYKVVSFSGNQIFFIRQDIAISIVNKAEFSTLNKMERAIDGSMIKENCIKLKIDRLGNIAKI

SEQ ID NO: 164 - protein, 1021 aa, Clostridium cellulolyticum
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 165 - protein, 1065 aa, Clostridium perfringens
  Clostridium perfringens C str. JGS1495
MNKDINYALGLDIGITSVGWAVINLDLNRIEDLGVRIFNAAENPKDGSSLALPRRLARGRRRLLRRKAYRVERVRKLIVKNNILTKEELEGLFKNKEVIDVWEARVKGLDYKLSREEWAKILINFCKRRGFKSNRKNETKDKEAGQILSSISYNIEKMKETNSRTIGEYIYNEVKNSDDSYAPLRNKFGEYKMCVSRDVLREEIHTLFEKQRELGNNFASDEIEDKYFEIFNSQRPFSNFEDLEKLVGFCTFERKKHKRAPKHCISSEEFTLYEGINKLSIIKDGEKRKLSEEERTLVVNEAFNKKEIKYTTLRKLLGLSEDELFSTLTYSIDKDISKTENTKFVSLKGYHEIKRAIEKGVSKKAWQDIENNRNLLNDIAYVLTLGKTDDEIEKQLRLRNVPEELFESLLDMSFSKFNNLSIYALEKILPFMKEGYQYNEACEKAGYNFKAIYEGVRTKKLPVIEIDEIVNPVVNRALAQTRKVINSVIDKYGSPVRINIELARDLAKNFKDRKLIEKEQKENRANLDKIRENLRELMDKEPTAVEVLKYRLWEQQRGECAYTQSQIALERLFSPGYCEIDHIIPFSRSFDDSLSNKILVLGSENQRKGNKIPYEYFGEDSERWNSFEIWVKGSYLNYKKKANLLKKKFTEEEQRDWKARNLQDTKYICRYISNFVNNRLEFKESENKQKVITVNGRATAYLRSRWGLNKVREDGDKHHALDAAVVGVTTQGMVQKISKYSKAHELYTVRKNDEFVDVETGECVDVDEYKEIRKDILPRPWRGFSEELKLRLSDNPLEELKKLPIETYNEEFIKENVKPIFVSRVPFRKISGKLFKETIYSERAFKDGYFVSKKSLVDLKRGDLDNFYNYECDKKLYDAISERMKEFNYNGKKAFESPFRKPTKSGKEGPVVRSVKIKSAAPFKDGIPMNEGLVAKEGMVRIDIYEKEGKYFVVPVYRYQLAKGIVPKRAAIAGKSELKWPIMDQTYNFKFSIFKNDLIEIKYAKKDGYFGYYDGFDRHTASLVIENHDNSDRYRGIGVKTGVVEFNKYEVDVLGNYHKVNLGGN

SEQ ID NO: 166 - protein, 1065 aa, Clostridium perfringens
  Clostridium perfringens D str. JGS1721
MNKDINYALGLDIGITSVGWAVINLDLNRIEDLGVRIFNAAENLKDGSSLALPRRLARGRRRLLRRKAYRVERVRKLILKNNILTKEELEGLFKNKEVIDVWEARVKGLDYKLSREEWAKILINFCKRRGFKSNRKNEAKDKEAGQILSSISYNIEKMKETNSRTIGEYIYNEVKNSEDSYAPLRNKFGEYKMCVSRDVIREEIHTLFEKQRELGNNFASDEIEDKYFEIFNSQRPFSNFEDLEKLVGFCTFERKKHKRAPKHCISSEEFTLYEGINKLSIIKDGEKRKLSEEERTLVVNEAFNKKEIKYTTLRKLLGLSEEELFSTLTYSIDKDISKTENTKFVSLKGYHEIKRAIEKGVSKKAWQDIENNRNLLNDIAYVLTLGKTDDEIEKQLRLRNVPEELFESLLDMSFNKFNNLSIYALEKILPFMKEGYQYNEACEKAGYNFKAIYEGVRTKKLPVIEIDEIVNPVVNRALAQTRKVINSVIDKYGSPVRINIELARDLAKNFKDRKLIEKEQKENRANLDKIRENLRELMDKEPTVVEVLKYRLWEQQRGECAYTQSQIPLERLFSPGYCEIDHIIPFSRSFDDSLSNKILVLGSENQRKGNRTPYEYFGEDSERWNSFEIWVKGSYLNYKKKANLLKKKFSEEEQRDWKARNLQDTKYICRYISNFVNNRLEFKESENKQKVITVNGRATAYLRSRWGLNKVREDGDKHHALDAAVVGVTTQGMVQKISKYSKAHELYTVRKNDEFVDVETGECVDVDEYKEIRKDILPRPWRGFSEELKLRLSDNPLEELKKSPIETYNEEFIKENVKPIFVSRVPFRKISGKLFKETIYSERAFKDGYFVSKKSLVDLKRGDLDNFYNYECDKKLYDAISERMKEFNYNGKKAFESPFRKPTKSGKEGPVVRSVKIKSAVPFKDGIPMNEGLVAKEGMVRIDIYEKEGKYFVVPVYRYQLAKGIVPKRAAIAKKDELKWPIMDQTYNFKFSIYKNDLIEVKYDKKGVYFGYYDGFDRNSASLTIEKHDNSERYRSIGLKVGVLEINKYEVDVLGNYHKVKLGGN

SEQ ID NO: 167 - protein, 1116 aa, Clostridium spiroforme
  Clostridium spiroforme DSM 1552
MVEFLLKEMKIMGRLVLGLDIGITSVGYGVIDIDKNEFVDYGVRLFKEGTAINNEERRSKRGARRLKRRKTNRIADMKKLLERNGLIDEQYTALNNPYEIRKKGLKNKLSNYELATAILHITKNRGTCLESNADETQDEESTKNILSKNALELKDKYICEIQLARLEESGKIRGINNNFKTEDYLKELSKILENQDLEKETIDKIKEIVARRRRYDQGPGSEKSPTPYGSYRMENGELVHVNLIDMMRGKCSVFPDQLRAPQQSYSAELFNLLNDLNNLKINGEKLSSTEKQKIIDFVNEKGGITVKQLLKLIDVGITEISGFRIDKNEKPLITEFKGYKKVLKVFKNYNQESLLNDKSIVDTIMDINTKIKSIDERSDQLKQVLPSLDTSIINDLASIKGVSGYHSLSLKALNLINNEMLKTEMNQMQVLHQLDIFDKNRVSLKGQRQIYADDNAILSPVAKRAHRETFKVINKLRSIYGEFDSIVIETTRDKNTQDQKKRIKNNQKNYEERNTEVNNFLKEAGYNPENINAKTKMKIRLYIEQDAKSAYTLQDINLKELIEDEKAYEIDHIIPISISLDDSFNNKVLTTHDENQEKGNLTPISAFLKGKFHNGNLNTYKVFIQNNKNLNRKKKEYLLCEDDITRYEVVQNFINRNLVDTSYACRTVMNTLVHYFKDNEINTKVHTIKGQATSTFRKRIGLIKDREEDYFHHAIDALIVASLKKMNLINSYLMKVDFNEMYDEETGEIFNVLPDNSYLDEKYISFVSNLKNIYEESNKYIRGVMIKEKMTYPLIKVSHKIDTKPNRKISDDTIYSTRNVDNQDMLVERIKNIYDPKENAANTLINDIINDNTDKYIMYHKDPQTFDKIKAIVLNHFNEFKTDKNCYIVTKEGLYKLKGTSPLALYYEEFGPITKYAKKNNGPTIHSMKFYSEKLGNHLSITHKYSTVNKKVITKQISPYRTDFYQSPEGKYKFVTVRYKDVAYNAKKDKYIIDHSWYREQKKLKKIADEWIFVCSVHRDELIGIMKADGQKRIFDSSTESDGETLYHDAKTYEILKFTATNNDITGRFEVKPIYCYCKKQLMVSIGTCRKIQKFATDVLGNLYIVKDNVLKLEFK

SEQ ID NO: 168 - protein, 1338 aa, Coprococcus catus
  Coprococcus catus GD/7
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 169 - protein, 1384 aa, Coriobacterium glomerans
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 170 - protein, 1099 aa, Corynebacterium accolens
  Corynebacterium accolens ATCC 49725
MSLSYRVGIDVGTYSLGCTAIEVDDNDQPVNILSSVSLIHDSGLDPDQQKRAVTRLASSGVARRTRRLYRRRRRRMINLEKFLTSQGWETRPFEHYSDPYLPWNARVALVNGYISDDAQRGMYLSIAFRHIANHRGWRNPYWKVSSLYSPDKPSDAFEQIRKELEESTGHKIPETVTVGQLISFAQFGKDRLRGGGKKKDEKKPQEQVNQAVISARLHQIDHAREINEICRVQKIDDALRKQILDLVFAAESPKGAQIGRVGKDPLQPKLPRALKASDAFQQYRIVALAGNLRIYRDGVSTPLDRDEKLIVFNYLINLSHKEEPSWLKVAEVLNIDRGQLHGTATMTDDGERAGAAPPVHDTNRTILGCKIKPLVHWWEGANDDERAAMLKALSNSEVEDFDSPAGAQTQAFFANLDESEQEKLDSLHLPIGRAAYSEDTLMRLTSRMLDENLDLYEARLAEFDIPKDWAPPAPRIGEPVGNPAVDRVLKGVARWLEAAADEWGAPKSVVIEHVRDGFISKSKANEIDRANNARHKRNRELFKQMQENLGIDGKLRSSDLWRYQSVQRQNCQCAYCGSPITYTTCEMDHIVPRAGEGSTNTRDNLVATCHRCNLAKKNIPFAVWAAQTNIPGVSVKEALDRTRHWSEDSGMTSKDFKKFRKNVCDRLKRTVVDEPLDARSMESVAWMANELRGRVAQRFQEENTVVNVYRGELTAEARRAAGISDKLRFIDGTGKSRLDRRHHAVDAAVVAFTQNYVAETLAIRSNKKREAQLLQAAEQWKEFTGSDAEHRAAWNAWLPKMQKLAVLLQKALDEDRIAVTSNLRLRLGNGRAHEDSIGELKTIRVGDAISVTDIDRASSEALWCALTREPDFDENNGLPENPDRRIRIHGTWYDAEDDIEVFPVGAGAIKVRGGYAELSRFHHARIYKIPGKKAPVYCMLRVYNADLIRHRHEDLFSVEIKPQTMSVRQAEPKLRKALAENTAEYLGWLVTDDELVIDTSNFNTGQIAEMQSELGQVRRWRLDGFYSPSTLRLRPLQMSAEGLREDTSIGAKKIIDRPGWLPAINKLFGEGHVTVVRRDALGRARLTSNAHLPISWKAE

SEQ ID NO: 171 - protein, 1099 aa, Corynebacterium accolens
  Corynebacterium accolens ATCC 49726
MSLLYRVGIDVGTYSLGCTAIEVDDNDQPVSILSSVSLIHDSGLDPDQQKRAVTRLASSGVARRTRRLYRRRRRRMVKLENFLTAQGWETLPFERYSDPYLPWHARVALVNGYISDDTQRGQYLSIAFRHIANHRGWRNPYWKVSSLYSPDKPSDAFEQIRKELEASTGRQIPETATVGQLISFAQFGKDRLRGGGKQKDKKKPQEQVNQAVISARLHQIDHAREINEICRVQKIDDTLRKQILDLVFAAESPKGAQKGRVGKDPLQPKLFRALKASDAFQQYRIAALTGNLRIYRNGVTVPLDRDEKLIVFNYLVNLPKKEEPSWLKIAEILNIDRGQLRGTATMTDDGERAGATPPVHDTNRTILDSKVKPLAHWWENASDDERAAMLKSLSNSEVEDFDSPAGAQVQAFFADLDETEQEKLDSLHLPMGRAAYSEDTLMRLTNRMLDENLDLYEARLAEFGIPKDWAPPAPRIGEPVGNPAVDRVLKGVARWLEAAADEWGAPKSVVIEHVRDGFVSKSKAIEIDRANNNRHKRNRELFQKMQENLGIEGKVRSSDLWRYQSVQRQNCQCAYCGSPITYTTCEMDHIVPRAGEGSTNTRDNLVATCHRCNLAKKNIPFAVWAEKSTIPGVSVKEALDRTRHWSEDSGMSKKDFQKFRKNVCERLNRTVVDEPLDARSMESVAWMANELRGRVAQRFQEENTTVNVYRGALTAEARRAAGITDKLRFIDGTGKSRLDRRHHAVDAAVVAFIHNYVAETLAIRSNKKREAQLLQGTSQWKEFTGSDDKHRAVWNAWIPKMQKLAVLLQIALDEDRIVVTSNLRLRLGNGRAHEDTISELKTIRVGDAISVTDIDRASSEALWCALTREPDFDEKDGLPENPNRRIRVHGTWYDAEDEIEVFPVGAGAIKVRGGYAKLSRFHHARVYKIPGKKAPIYCMLRVYNTDLVQHRHEDLFSVELKPQTMSVRQAEPKLRKALAENTAEYLGWLVTDDELIIDTSTFRTGLIEEMQSEFGLVRRWRLDGFDSPSLLTLRPLHMSAEGLPDDCALGSRKIIDTKGWRVSINKVFNAGNTTVVRRDALGRARLTSNAHLPISWKEE

SEQ ID NO: 172 - protein, 1084 aa, Corynebacterium diphtheriae
MKYHVGIDVGTFSVGLAAIEVDDAGMPIKTLSLVSHIHDSGLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLKSATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 173 - protein, 1084 aa, Corynebacterium diphtheriae
MKYHVGIDVGTFSVGLAAIEVDDAGMPIKTLSLVSHIHDSGLDPDKMKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKSIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 174 - protein, 1084 aa, Corynebacterium diphtheriae
MKYHVGIDVGTFSVGLAAIEVDDAGMPIKTLSLVSHIHDSRLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNIQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRVTMDEEIDARSMESVAWMANELRSRVAQHFASRGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 175 - protein, 1084 aa, Corynebacterium diphtheriae
  Corynebacterium diphtheriae bv. intermedius str. NCTC 5011
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMQRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSPDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLGSQLSVSDIDKASSEALWCALTREPDFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 176 - protein, 1084 aa, Corynebacterium diphtheriae
MKYHVGIDVGTFSVGLAAIEVDDAGMPIKTLSLVSHIHDSGLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 177 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVWVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPERAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRATWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 178 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDYAREIQEICRMQEIGQELYRKIIDVVFAAESPKGSASSRVGKDPLQPGKNRALKASDAFQRYRIAALIGNLRVRVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLSSQLSVSDIDKASSEALWCALTREPGFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 179 - protein, 1084 aa, Corynebacterium diphtheriae
MKYHVGIDVGTFSVGLAAIEVDDAGMPIKTLSLVSHIHDSGLDPDKMKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKSIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDSFQRYRIAALISNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVRDGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKELAPELSKIIDRPGWLPAVNKLFSEGNVTVVRRDSLGRVRLESTAHLPVTWKVQ

SEQ ID NO: 180 - protein, 1089 aa, Corynebacterium matruchotii
  Corynebacterium matruchotii ATCC 14266
MNSANVNYRVGIDVGSYSLGMAAIAIDDDGKPTEILSAISLIHDSGVDPDSAKSAATRLATSGIARRTRRLYRRKRKRLAKLDKFISSQGWPLKEFEKYEDPFYPWRVRAELATTAITDQQELGEKLSIALRHIARHRGWRNPYSKVTALYTVTEPSDAFLAMQEECAKQLGRTIPETITVGQLVTGMNLGKTRLRGENSLLAARPRQSDNANEIHTIAKVQGLSNELVRQIIDHVFAAESPKGSAAEQVGKDPLQPTKKRALKASDAFQQYRIAALIGNLRIRGGKGNRRLTTEETRLVFDYLRSLPAKQEPTWQLVAEQLKIDRGNLVGTAIMTDDGERAGAKPPVHDTNRIMENTKIKPLATWWKSADADARAAMVKALSNAEVDDFDSQAGAQVQEFFFGISDEDQEKLDGLHLPIGRAAYSEDTLDRLTKRMIGEGMDLYEARQAEFKISNDWAPPAPEIGERVGNPAVDRVLKATARWLNAAERQWGAPKSVNIEHVRAAFMSESSARELDRDNQQRAKRNVKVVAEMQEKLGIEGRPSRADVWRFQSIQRQNGKCAYCGAEISFKNSEMDHIIPQAGEGSTNTRDNLVAVCRECNSSKSNIAFAVWAENTSRPGVSVQKAIERTHHWVTDSGLRKPEFDKFRKQVCDRLRRKATDEPIDARSLESVAWMANELRSRIAQKFKDGDTKVRVYKGALTAEARRASGISGKLEFVDGKGKSRLDRRHHAVDAAVVAFTSNYVAETLALRSNMKFDQELRRKAPQWREFTGSDHVHQVEWTKWKYRMQALAELLNNALVQDRIVVMHNLRLRLGNGAAHEDTIGKLTRLKVGDAISTTDIDRASSEALWCALTRDPDYDPKTGLPENPNRTIRIHGTHLTASDEITVFPVAAASIPIRDGFAKLGSNYHHVRLFRVPSGKKYKYCLMQVYTVDLLKFRKEDLFTVELKPQTISVRTCEALLRKALANGTAEYLGWLVSDDELLIDTSSFDTPGIVKLREEYGPVNRWRLAGLTSVTRLNLRPLYLSKEGLKPNVNPEIKKIIDNRSWIITVNKLFSSGHVKIIRRDALGRPRLHSAAHLPICWEVK

SEQ ID NO: 181 - protein, 1069 aa, Corynebacterium matruchotii
  Corynebacterium matruchotii ATCC 33806
MAAIAIDDDGKPTEILSAISLIHDSGVDPDSAKSAATRLATSGIARRTRRLYRRKRKRLAKLDKFISSQGWPLKEFEKYEDPFYPWRVRAELATTAITDQQELGEKLSIALRHIARHRGWRNPYSKVTALYTVTEPSDAFLAMQEECAKQLGRTIPETITVGQLVTGMNLGKTRLRGENSLLAARPRQSDNANEIHTIAKVQGLSNELVRQIIDHVFAAESPKGSAAEQVGKDPLQPTKKRALKASDAFQQYRIAALIGNLRIRGGKGNRRLTTEETRLVFDYLRSLPAKQEPTWQLVAEQLKIDRGNLVGTAIMTDDGERAGAKPPVHDTNRIMENTKIKPLATWWKSADADARAAMVKALSNAEVDDFDSQAGAQVQEFFFGISDEDQEKLDGLHLPIGRAAYSEDTLDRLTKRMIGEGMDLYEARQAEFKISNDWAPPAPEIGERVGNPAVDRVLKATARWLNAAERQWGAPKSVNIEHVRAAFMSESSARELDRDNQQRAKRNVKVVAEMQEKLGIEGRPSRADVWRFQSIQRQNGKCAYCGAEISFKNSEMDHIIPQVGEGSTNTRDNLVAVCRECNSSKSNIAFAVWAENTSRPGVSVQKAIERTHHWVTDSGLRKPEFDKFRKQVCDRLRRKATDEPIDARSLESVAWMANELRSRIAQKFKDGDTKVRVYKGALTAEARRASGISGKLEFVDGKGKSRLDRRHHAVDAAVVAFTSNYVAETLALRSNMKFDQELRRKAPQWREFTGSDHVHQVEWTKWKYRMQALAELLNNALVQDRIVVMHNLRLRLGNGAAHEDTIGKLTRLKVGDAISTTDIDRASSEALWCALTRDPDYDPKTGLPENPNRTIRIHGTHLTASDEITVFPVAAASIPIRDGFAKLGSNYHHVRLFRVPSGKKYKYCLMQVYTVDLLKFRKEDLFTVELKPQTISVRTCEALLRKALANGTAEYLGWLVSDDELLIDTSSFDTPGIVKLREEYGPVNRWRLAGLTSVTRLNLRPLYLSKEGLKPNVNPEIKKIIDNRSWIITVNKLFSSGHVKIIRRDALGRPRLHSAAHLPICWEVK

SEQ ID NO: 182 - protein, 1079 aa, Dinoroseobacter shibae
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 183 - protein, 1332 aa, Dolosigranulum pigrum
  Dolosigranulum pigrum ATCC 51524
MQKNYTIGLDIGTNSVGWAVMKDDYTLIRKRMKVLGNTDIKKIKKNFWGVRLFDEGETAKETRLKRGTRRRYQRRRNRLIYLQDIFQQPMLAIDENFFHRLDDSFFVPDDKSYDRHPIFGSLEEEVAYHNTYPTIYHLRKHLADNPEKADLRLVYTALAHIVKYRGHFLIEGELNTENTSISETFEQFLDTYSDIFKEQLVGDISKVEEILSSKQSRSRKHEQIMALFPNENKLGNFGRFMMLIVGNTSNFKPVFDLDDEYKLKLSDETYEEDLDTLLGMTDDVFLDVFMAAKNVYDAVEMSAIISTDTGNSKAVLSNQMINFYDEHKVDLAQLKQFFKTHLPDKYYECFSDPSKNGYAGYIDGKTNQEDFYKYIEKVMKTIKSDKKDYFLDKIDREVFLRKQRSFYNSVIPHQIHLQEMQAILDRQSQYYPFLAENRDKIESLVTFRIPYYVGPLTVSDQSEFAWMERQSDEPIRPWNFDEIVNKERSAEKFIERMTNMDTYLLEEKVLPKRSLLYQTFEVYNELTKVRYTNEQGKTEKLNRQQKAEIIETLFKQKNRVREKDIANYLEQYGYVDGTDIKGVEDKFNASLSTYNDLAKIDGAKAYLDDPEYADVWEDIIKILTIFEDKAMRKKQLQTYSDTLSPEILKKLERKHYTGWGRFSKKLINGLRDEGSNKTILDYLKSDEGSSGPTNRNFMQLIRDNTLSFKKKIEDAQTIEDTTHIYDTVAELPGSPAIKKGIRQALKIVEEIIDIIGYEPENIVVEMARESQTTKKGKDLSKERLEKLTEAIKEFDGPSDVKVKDLKNENLRNDRLYLYYLQNGRDMYTNEPLDINNLSKYDIDHIIPQSFTTDNSIDNKVLVSRTKNQGNKSDDVPSINIVHKMKPFWRQLHKAGLISDRKFKNLTKAEHGGLTEADRAHFLNRQLVETRQITKHVANLLDSQYNTAEEQRINIVLLKSSMTSRFRKEFKLYKVREINDYHHGHDAYLNAVVATTIMKVYPNLKPQFVYGQYKKTSMFKEEKATARKHFYSNITKFFKKEKVVNEETGEILWDTERHLSTIKRVLSWKQMNIVKKVEKQKGQLWKETIYPKGDSSKLIPVKEGMDPQKYGGLSQVSEAFAVVITHEKGKKKQLKSDLISIPIVDQKAYEQHPTAYLEEAGYNNPTVLHELFKYQLFELEDGSRRMIASAKEFQKGNQMVLPLELVELLYHANRYDKVKFPDSIEYVHDNLAKFDDLLEYVIDFSNKYINADKNVQKIQKIYKEHGTEDVELTVESFVNLMTFTAMGAPATFKFYGESITRSRYTSITEFRGSTLIFQSITGLYETRYKLEDN

SEQ ID NO: 184 - protein, 1340 aa, Dorea longicatena
  Dorea longicatena DSM 13814
MEQEYYLGLDMGTGSVGWAVTDSEYHVLRKHGKALWGVRLFESASTAEERRMFRTSRRRLDRRNWRIEILQEIFAEEISKKDPGFFLRMKESKYYPEDKRDINGNCPELPYALFVDDDFTDKDYHKKFPTIYHLRKMLMNTEETPDIRLVYLAIHHMMKHRGHFLLSGDINEIKEFGTTFSKLLENIKNEELDWNLELGKEEYAVVESILKDNMLNRSTKKTRLIKALKAKSICEKAVLNLLAGGTVKLSDIFGLEELNETERPKISFADNGYDDYIGEVENELGEQFYIIETAKAVYDWAVLVEILGKYTSISEAKVATYEKHKSDLQFLKKIVRKYLTKEEYKDIFVSTSDKLKNYSAYIGMTKINGKKVDLQSKRCSKEEFYDFIKKNVLKKLEGQPEYEYLKEELERETFLPKQVNRDNGVIPYQIHLYELKKILGNLRDKIDLIKENEDKLVQLFEFRIPYYVGPLNKIDDGKEGKFTWAVRKSNEKIYPWNFENVVDIEASAEKFIRRMTNKCTYLMGEDVLPKDSLLYSKYMVLNELNNVKLDGEKLSVELKQRLYTDVFCKYRKVTVKKIKNYLKCEGIISGNVEITGIDGDFKASLTAYHDFKEILTGTELAKKDKENIITNIVLFGDDKKLLKKRLNRLYPQITPNQLKKICALSYTGWGRFSKKFLEEITAPDPETGEVWNIITALWESNNNLMQLLSNEYRFMEEVETYNMGKQTKTLSYETVENMYVSPSVKRQIWQTLKIVKELEKVMKESPKRVFIEMAREKQESKRTESRKKQLIDLYKACKNEEKDWVKELGDQEEQKLRSDKLYLYYTQKGRCMYSGEVIELKDLWDNTKYDIDHIYPQSKTMDDSLNNRVLVKKKYNATKSDKYPLNENIRHERKGFWKSLLDGGFISKEKYERLIRNTELSPEELAGFIERQIVETRQSTKAVAEILKQVFPESEIVYVKAGTVSRFRKDFELLKVREVNDLHHAKDAYLNIVVGNSYYVKFTKNASWFIKENPGRTYNLKKMFTSGWNIERNGEVAWEVGKKGTIVTVKQIMNKNNILVTRQVHEAKGGLFDQQIMKKGKGQIAIKETDERLASIEKYGGYNKAAGAYFMLVESKDKKGKTIRTIEFIPLYLKNKIESDESIALNFLEKGRGLKEPKILLKKIKIDTLFDVDGFKMWLSGRTGDRLLFKCANQLILDEKIIVTMKKIVKFIQRRQENRELKLSDKDGIDNEVLMEIYNTFVDKLENTVYRIRLSEQAKTLIDKQKEFERLSLEDKSSTLFEILHIFQCQSSAANLKMIGGPGKAGILVMNNNISKCNKISIINQSPTGIFENEIDLLKI

SEQ ID NO: 185 - protein, 1380 aa, Eggerthella sp.
  Eggerthella sp. YY7918
MNLRHVGNYNIGLDMGTASVGWAAIDEQGELLHFKGKPTWGSRLFDSANTAATARMPRGQRRRYIRRRWRLDLLQKFFSEEMAEKDPEFFIRLRQSSLWPEDREGGHTAYHWPLFNDSDFNEKEYYEKFPTIFHLRQWLMETDEKADIRLIYLAFHNIVKHRGNFLQENNDSLSAQNANMRESLESFCIALEEWCDEKELTCSCDPQKLEHLFKEVKYRSDIRDGFAALLGLACSGENEVDVKAMAKEMGKAIVGYKADFSKIFTECDKEGSSFRLSDDEGPEAFLDICPDDGIALFEAIQMVYSSFILTGMLTEKGLSLSKISAYNQYGQDLESLKALVKEYVPNEYSSFFRGPTYSGSTEYDPSKAQGYTRYNLGPSKKGSGAKPMAYEDFKKSVEQLFANTNAINDERYKEMMGRFAEEKFLRRLRTSDNGRIPFQLNLEEMTAIIINQGKYYPFLLEQQEKLESLVRFRIPYYVGPLTRINARLDSKGNACFAWSKRKDGMDSASIKPWNWDEVIDKHASAQAFIERMTGTCTYLRGEPVLPRCSLLYEEYCVLNELNGARWTQDGDKFIRFDYKDRSDIIEELFKKRRGRIQYAAVADWMKQERSHANVHVSGGQGENAFESRLSSYHFFCNDVFGVDELPGSYVDMVEEIILWSTLFEDRSILREEIQRKYGDVLNEEQIKTICKKRFSGWGRLSRKLLCSLKAQTDNGPKSIMDILQEGDQNNGRVGRAMVFQEILHDEQLGFEQKIEEENTQSMLEGENLLIEDLPGSPAIRRSINQAVRIVDEIVGIAGHAPDNIFIEVTREDDTKKKGKRTTTRYSNIQKALEALKEEGAEALRELKTYKHNELDKRLSLYFMQNGKSLYSGIPLDIRRLSEYQIDHIIPQSYIKDDSYENMALVLPGENQSKADNLLISQDIRIKMKATWTALHKAGLMGDKKYNNLMNSSISDAKMKGFINRQLVETSQSVKLTQMMLSQKYPGAKVRPIKASISSQLRDACDLVKCREANDYHHAHDAYLACQVGRFVLKRHSSMFDNPIGMTKVIRDFVKRQGQEFKRNGKLPAYASRSGFIVQSFMRSGFDAETGELLRDDWNAPFEIARIKRCLNYRDCYISRMPMEDSGAFWDATIYSPKAGKKGALPVKQGLPVEKYGSYSREQFAYFFVYKAYNPKKKAYRLEFEAVPVRVASAVETRENALEEYAKSVAKQAGLEFVEVARPKVYKYQLIELGEDRLYITGKREVRNASQLAFSLDEIDLLKRLAEGEETSSEERERLFDVLIEKYARYAPRLARQLSVDSMSATFETLNAEEQLGILLSLVEIANGKRNMIDLSSAGGSKNAGCMNPTFSSELSSPGSNFTFIDQSVTGMFERRQRLEL

SEQ ID NO: 186 - protein, 1195 aa, Elusimicrobium minutum
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 187 - protein, 1337 aa, Enterococcus faecalis
  Enterococcus faecalis ATCC 29200
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 188 - protein, 1337 aa, Enterococcus faecalis
  Enterococcus faecalis ATCC 4200
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYIGPLSKGDASTFAWLKRQSEEPIRPWNLQETVDLDQSATAFIERMTNFDTYLSSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 189 - protein, 1337 aa, Enterococcus faecalis
  Enterococcus faecalis D6
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDANTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYQFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 190 - protein, 1337 aa, Enterococcus faecalis
  Enterococcus faecalis E1Sol
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKEQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKKVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKTIIYTNLMRFFTEDEPRFTKDSEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 191 - protein, 1150 aa, Enterococcus faecalis
  Enterococcus faecalis Fly1
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDRLIGKDFQGELRASGLSLSAQQYNLLNDLTNLKIDGEIPLSPEQKEYILAELMTKEFTRFGVNDVAKLLGVKKERLSGWRLDKKGKPEIHTLKGYRNWRKIFAESGIDLATLPTETIDCLAKVLTLNTEHEGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANHETKVRVVNGSFTHTLRKKWGADLDKTRETHHHHAVDATLCAVTPFVKVSRYHYAVKEETGEKVMREIDFETGEIVDEMSYQEFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLYYEKEPKNIIK

SEQ ID NO: 192 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILNQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 193 - protein, 1150 aa, Enterococcus faecalis
  Enterococcus faecalis R508
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRKNAQLLTKYTPGQIQLQRLKENNRVKTGINVQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTPFVKVSRYHYAVKEETGEKVMREIDFETGEIVNEMSYREFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEIMPAENQFKQKPYNNGAINLNIAKYGKEGKKLRKFNTDILGKKHYLFYEKEPKNIIK

SEQ ID NO: 194 - protein, 1150 aa, Enterococcus faecalis
  Enterococcus faecalis T11
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRENAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDKLIGKDFQGELRASGLSLSAQQYNLLNDLTNLKIDGEIPLSPEQKEYILAELMTKEFTRFGVNDVVKLLGVKKERLSGWRLDKKGKPEIHTLKGYRNWRKIFAESGIDLAMLPTETIDCLAKILTLNTEREGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANQETKVRVVNGSFTHTLRKKWGADLDKTRETHHHHAVDATLCAVTPFVKVSRYHYAVKEETGEKVMREIDFETGEIVDEMSYREFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIRKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLYYEKEPKNIIK

SEQ ID NO: 195 - protein, 1150 aa, Enterococcus faecalis
  Enterococcus faecalis TX0012
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSRGEIYKVTLHILKKRGISYLDEVDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTSFVKVSRYHYAVKEETGEKVMREIDFETGEIVNEMSYWEFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLFYEKEPKNIIK

SEQ ID NO: 196 - protein, 1150 aa, Enterococcus faecalis; identical to SEQ ID NO: 195
  Enterococcus faecalis TX0012

SEQ ID NO: 197 - protein, 1337 aa, Enterococcus faecalis
  Enterococcus faecalis TX0470
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSTPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 198 - protein, 1150 aa, Enterococcus faecalis
  Enterococcus faecalis TX1342
MYSIGLDLGVSSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRENAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDKLIGKDFQGELRASGLSLSAQQYNLLNDLTNLKIDGEIPLSPEQKEYILAELMTKEFTRFGINDVAKLLGVKKERLSGWRLDKKGKPEIHTLKGYRNWRKIFAESGIDLATLPTETIDCLAKVLTLNTEREGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANQETKVRVVNGSFTHTLRKKWGADLDKTRETHHHHAVDATLCAVTPFVKVSRYHYAVKEETGEKVMREIDFETGEIVDEMSYREFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIRKYAKNNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQCYDVRFYNFQSANSINFKGLEQEMMPAENQFKQKPYNNGAINLNIAKYGKEGKKLRKFNTDILGKKHYLYYEKEPKNIIK

SEQ ID NO: 199 - protein, 1337 aa, Enterococcus faecalis
  Enterococcus faecalis TX4244
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENLGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 200 - protein, 1339 aa, Enterococcus faecium
  Enterococcus faecium 1,141,733
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 201 - protein, 1340 aa, Enterococcus faecium
  Enterococcus faecium 1,231,408
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVPDEKKQSRHPVFATIKQEKSYHQTYPTIYHLRQALADSSEKADIRLVYLAMAHLLKYRGHFLIEGELNTENSSVTETFRQFLSTYNQQFSEAGDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEAFYKFVKKELTGIRGSEVFLTKIEQENFLRKQRTFDNGVIPHQIHLSELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNDPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 202 - protein, 1339 aa, Enterococcus faecium
  Enterococcus faecium E1133
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSEETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 203 - protein, 1340 aa, Enterococcus faecium
  Enterococcus faecium E3083
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNCMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPTKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 204 - protein, 1340 aa, Enterococcus faecium
  Enterococcus faecium PC4.1
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 205 - protein, 1340 aa, Enterococcus faecium
  Enterococcus faecium TX1330
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMNNTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 206 - protein, 1340 aa, Enterococcus faecium
  Enterococcus faecium TX1337RF
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 207 - protein, 1336 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 208 - protein, 1330 aa, Enterococcus italicus
  Enterococcus italicus DSM 15952
MKNDYTIGLDIGTNSVGYSVVTDDYKVISKKMNVFGNTEKKSIKKNFWGVRLFESGQTAQEARMKRTSRRRIARRKNRICYLQEIFQPEMNHLDNNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEGFQFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIEDESDSYIVNRNFMQLINDDHLSFKKIIEDSQPYKEQQSAEEIVSELSGSPAIKKGILQSLKIVDELVAIMGYKPKNIVVEMARENQTTGRGKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVETRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDYIINDDGEILWNKQETIAQVIKTLGMHQVNVVKKVEIQKGGFSKESIQPKGESQKLIRRKQQWNTKKYGGFDSPVVAYAILLSFDKGKRKARSFKIVGITIQDRESFEGNPILYLSKKDYHNPKVEAILPKYSLFEFENGRRRMVASASETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

SEQ ID NO: 209 - protein, 1096 aa, Eubacterium dolichum
  Eubacterium dolichum DSM 3991
MMEVFMGRLVLGLDIGITSVGFGIIDLDESEIVDYGVRLFKEGTAAENETRRTKRGGRRLKRRRVTRREDMLHLLKQAGIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELSVKGMKNIQADDTAILSPVAKRAQRETFKVVNRLREIYGEFDSIVVEMAREKNSEEQRKAIRERQKFFEMRNKQVADIIGDDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQKEFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNRSVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISPYRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 210 - protein, 1114 aa, Eubacterium rectale
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 211 - protein, 1391 aa, Eubacterium sp.
  Eubacterium sp. AS15
MENKQYYIGLDVGTNSVGWAVTDTSYNLLRAKGKDMWGARLFDEAKTAVERRTKRTSRRRSEREKARKAMLKELFADEINKVDPNFFIRLEESKFFLDDRSENNRQRYTLFNDAKFTDKDYYEKYKTIFHLRSALINSDEKFDVRLVFLAILNLFSHRGHFLNASLKGDGEIQGVDIFYNDLYEVCEEFEIDLPQISNIDNFEKILSQKGKSRTKILEELSEELSISKKEKIKYSLLKLICGMKIKVVDIYADEDIQEDDKKKDLGFRESDYEKSSLEVKEIIGDDHFELIERAKAVHDIGLLANIIGNSKYLCEARVEAYDNHHKDLQKIKELLKKYDIKAYTDMFRKMTDKNYSAYVGSVNSNIAKERRSVDNRKIEDLYEYIKKIALKNISDDNEDKIEILKKIETGEFLKKQLTASNGVIPNQLQSRELRAILKKAENYLPFLKEKGEKNLTVSEMIIQLFEFQIPYYVGPLDKNPKKDKNANSWAVIPSGGRILPWNFEDKVDVKGSRKEFIEKMVRKCTYLSEEHTLPKQSLLYEKFMVLNEINNIKIDGEKISVEAKQKIYNDLFMKGKKVSQKAIKQELISLNIMSKDSVLSGIDTVCNAYLSSIAKFRGVFDENVNNQSTIDMIEDIIFLKTVYSDEKRFVKEEIVEKYGDEIDKDKIKRILGFKFSNWGNISKSFLELEGADVGTGEIRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYSAIKEDSKQWVKELDAKDESYFRSKKMYLYYLQKGRCMYSGEVIELDKLMDDNLYDIDHIYPRSFVKDDSLDNLVLVKKEINNRKQNDPITPQIQASCQGFWKVLHEQGFISNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPAYKYHMDRFFERDVKSKSEVAWIGQSEGNAGTIAIVKKTMSKNSPLITKKVEEGHGSITKETIVGVKEIKFGRNKVEKADKTPKKANLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 212 - protein, 1107 aa, Eubacterium ventriosum
  Eubacterium ventriosum ATCC 27560
MGYTVGLDIGVASVGVAVLDENDNIVEAVSNIFDEADTSNNKVRRTLREGRRTKRRQKTRIEDFKQLWETSGYIIPHKLHLNIIELRNKGLTELLSLDELYCVLLSMLKHRGISYLEDADDGEKGNAYKKGLAFNEKQLKEKMPCEIQLERMKKYGKYHGEFIIEINDEKEYQSNVFTTKAYKKELEKIFETQRCNGNKINTKFIKKYMEIYERKREYYIGPGNEKSRTDYGIYTTRTDEEGNFIDEKNIFGKLIGKCSVYPEEYRASSASYTAQEFNLLNDLNNLKINNEKLTEFQKKEIVEIIKDASSVNMRKIIKKVIDEDIEQYSGARIDKKGKEIYHTFEIYRKLKKELKTINVDIDSFTREELDKTMDILTLNTERESIVKAFDEQKFVYEENLIKKLIEFRKNNQRLFSGWHSFSYKAMLQLIPVMYKEPKEQMQLLTEMNVFKSKKEKYVNYKYIPENEVVKEIYNPVVVKSIRTTVKILNALIKKYGYPESVVIEMPRDKNSDDEKEKIDMNQKKNQEEYEKILNKIYDEKGIEITNKDYKKQKKLVLKLKLWNEQEGLCLYSGKKIAIEDLLNHPEFFEIDHIIPKSISLDDSRSNKVLVYKTENSIKENDTPYHYLTRINGKWGFDEYKANVLELRRRGKIDDKKVNNLLCMEDITKIDVVKGFINRNLNDTRYASRVVLNEMQSFFESRKYCNTKVKVIRGSLTYQMRQDLHLKKNREESYSHHAVDAMLIAFSQKGYEAYRKIQKDCYDFETGEILDKEKWNKYIDDDEFDDILYKERMNEIRKKIIEAEEKVKYNYKIDKKCNRGLCNQTIYGTREKDGKIHKISSYNIYDDKECNSLKKMINSGKGSDLLMYNNDPKTYRDMLKILETYSSEKNPFVAYNKETGDYFRKYSKNHNGPKVEKVKYYSGQINSCIDISHKYGHAKNSKKVVLVSLNPYRTDVYYDNDTGKYYLVGVKYNHIKCVGNKYVIDSETYNELLRKEGVLNSDENLEDLNSKNITYKFSLYKNDIIQYEKGGEYYTERFLSRIKEQKNLIETKPINKPNFQRKNKKGEWENTRNQIALAKTKYVGKLVTDVLGNCYIVNMEKFSLVVDK

SEQ ID NO: 213 - protein, 1391 aa, Eubacterium yurii
  Eubacterium yurii subsp. margaretiae ATCC 43715
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 214 - protein, 1142 aa, Facklamia hominis
  Facklamia hominis CCUG 36813
MYSVGLDIGIASCGYSIINDVNGNIVELGTLLFKSRNSDNNEERRTNRGSRRLINRRRTRLDDGKKLLAEKGFKQDSKLKHVCPYELRVKGLHEKLTQGEIYKVVLHILKKRGISYLDESDENSSGIDGASYKDQVNLNLNLQKELTPGQIQLKRLKENGRIKSGVTFENGYQLNVFSVSAYANELNKILTKQSEYYSEIDQIWIDRFTKNGYRKEAGLVYRKRPYYDGPGNEKNNSIYGRWANFKEDGHPKENIFDQLIGLDSVDSTQVRASASTLTAQKYNLLNDLNNLTIIEDDRKFTTDEKVSIINYLMTQDITRFGPKELAKFYQLEVDQIRGWRIDNKGNPEIHSLKVYRDWKKIFNTSSIDLTSIQTWVVDELANVITLNTEIPSTLATLKIKIPDIDQQILNFVENNFYELKKKTSKNSWHSFSLKTLNILIPELLNTSEEQNTILERLNLKFDLKNKYAEKNQIPVKELLEQIYNPTVTKSVHQSIKLFNEIIEKYGKNNISYVTIEMPRDKNDQDQKDTIKRINKLNSERKNDSEKYFLERSGWDTIRFESALKKPRFAEKLLFYYEQKGKCAYSGQDILAESLLNESCEVDHIIPLSISFDDSIHNKVLVTASSNQEKGQRTPYMAFIDGAKLGQSWDDFVAWVNSCGFHRKKVQNLLYEENIFNPDVQRGFVSRNLNDTRYASRIVLNAIQSFFYKQKDLTKVKVVNGSFTHTLRKKWGSSLDKNRDTYHHHAVDATLCAVTPFINIVKYEFFEEDGIKYMVDLTTGEKVAYSDYKKMKFYDKRAYVPIWDGFIKQLTPANLYPKIKFSHQVDSKWNRKISDATIYSTRKIVETKINKKGVAKETVKDIVIDKIKDIYTPEGWRKFKEKQDKLLMKNFDEKTYNKLIKIAKEYPEKKEVQTSNGKVSLVEVSPFKMYCEEQNVPAIRKYSKKGNGPYIRSLKFYDKELGKHINITKDSYGNDIERTIRNKKIILKNQNSWRTDVYYNSVNNCYELLGIKYCHLKFYRGKYGIPKSIYDELKKEDEISSESVFKFSLYRHDRVRFEKDGEYIEALFGSKNESNKNYLELSPIDKNKWLSKENVKFFGEVAASGRFIKGLKPGIKVIKQSTDYMGHVYAIHQEKLKFVLSDA

SEQ ID NO: 215 - protein, 1512 aa, Fibrobacter succinogenes
MKKILGLDLGTNSIGWAVVNADEITRDDGSRYLKPNGISAAGSRIIPMSADILGDFEKGNSISQTAERTRMRMARRLHERALLRRERLLRVLNLLDFLPKHFADKIDRYGKFTDDSEPKLAWRKNTEGKYEFIFQDAFNEMLAEFKDKQPEIVEEGKKIPYDWTIYYLRKKALEKALSKEELSWILLQFNQKRGYYQLRGEEEEIPQDKKIEYLAQKVVKVEATDQKKGDDVWYNVYLENGMIYRRTSKAPLDWEGKVKEFIVTTEVENDGETPKKDKEGNIKRSFRAPKEDDWTLLKKKTEADIENSHKTVGCYIYDSLLNNPKQKIIGKLVRTVERKFYKEELTQILKKQVELIPELRDDNLYKQCIEELYPINEAHRNTIAKTDFANLFINDILFYQRPLKSKKSQIDNCPYEERIFIDSKTGEKKKVPVKCIAKSNPLFQEFRLWQFIQNLRIYQREKEIDGKLLTDIDITSECLKSEEDYVRLFDWLNDRETIEQEDLLKHLFNTKKSKNKENPYRWNYVEDKVYPCNETRATILKGFSKCGINASVLSPELEMALWHILYSVEDKKEIETALTHFAQKQGWNDDFAKVFSKAKPFKKDYGSYSEKAIKKLLSLMRMGKYWNQDNIDKNTLDRIDKIINGEYDEKISNRVRDNAINLKDISDFRGLPVWLACYIVYDRHSEAKDCTKWNSPEEIDSYLKKFKQHSLRNPIVEQVVTETLRTVRDIWIQEEQIDEIHLELGRDLKNPADKRKKMSENILKNENTNLRIKAMLMEFMNPSMGIENVRPYSPSQQDILRIYEENALDNLTKDDKDFDFISKISKQAQPSKTDIIRYKCWLEQKYRSPYTGKTISLSKLFTPAYEIEHVIPQSLYFDDSFSNKVICEAEVNKLKDRQLGYKFIAEHHGEKVQLSQGEVVEILSVDAYEKFVKENYANNRIKMKKLLMESIPDEFIERQLNDSRYISKVVKGLLSNIVREKIDDENYEPEAVSKNLISCNGAITDRLKKDWGMNDVWNSIILPRFIRMNQITGKDCFTTTNAEGHLIPQMPLELQKGFNKKRIDHRHHAMDAIVIACTTRDHVNLLNNEAAHSKFNATRYQLQRKLRRFEKAVIDGKEREVAKEFLKPWDSFSSDSKNILENIIVSFKQNQRVINKTTNAFLHFDENGKKTFIKQGKGDSWAIRKSMHKDTVFGEINLRKVRSVSLNEAIKVPERVLNKKIKEKILELKNNKIDAKNIKKYIEENHTGGYGIDSSKIDVFYFTKETKERFFATRKTLDTSFNQAKIKDSIADSGIQKILLAHLKSKNGDAEQAFSPDGIDEMNKNIVELNNGKFHQPILKVRVYEKADKFAVGQKGNKKVKFVEAAKGTNLFFAIFEKDGKRSYLTIPLNVMIDCQKQYGNQWKNNIEAYLKEKELVEKDVKLQFILSPNDLVYLPTEGSIDKKRIYKVVSFTNNRLYAIPYAIAKSIVDKNEFTQLNKIEFTDNKESIKDACVPVIIDRLGNVIEFNGKRL

SEQ ID NO: 216 - protein, 1365 aa, Filifactor alocis
MTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 217 - protein, 1347 aa, Finegoldia magna
  Finegoldia magna ACS-171-V-Col3
MKSEKKYYIGLDVGTNSVGWAVTDEFYNILRAKGKDLWGVRLFEKAKTAADTRTFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFVILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEAVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRIKGKPLDTDVKLKLIEELFKKKTKVTLKSIRDYMIRNNFADKEDFDNSEKNLEIVSNMKSYIDFNNILGDKFELEMVEDLIEKITIHTGNKTLLKKYIEETYPDLSSSQIQKIINLKYKDWGRLSRKLLDGIKGRNKTDDVNTVINFMRNSSDNLMQIIEGKNYSFNEYIDNLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDESELRSKKLYLYYTQMGRDMYTGEKIDLDKLFDSTHYDKDHIIPQSMKKDDSIINNLVLVNKNANQTTKGNIYPVPSSIRNNPDIYNYWKYLMEKEFISKEKYNRLIRNTPLTNEELGVFINRQLVETRQSTKAIKELFEKFYQKSKIIPVKASLASDLRKDMNTLKSREVNDLHHAHDAFLNIVAGDVWNREFTSNPINYVNENREGDKVKYSLSKYFTRPRKSKGKVIWTPEKGRKLIVDTLNKPSVLISNESHVKKGELFNATISGKKDYKKGKIYLPLKKDDRLKDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 218 - protein, 1348 aa, Finegoldia magna
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 219 - protein, 1348 aa, Finegoldia magna
  Finegoldia magna SY403409CC001050417
MKSEKKYYIGLDVGTNSVGWAVTDEFYNILRAKGKDLWGVRLFEKAKTAADTRTFRSGRRRNDRKGVRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKQQLILLINDLLKIELEEEFMDSIFEILADVNEKKTEKKNILKELINAQDFNKQEGKILYSIFESIVTGKAKIKNIISDEDILEKIKEDNKEDFVLTGDSYEENLQYFEEVLQENITLFNTLKSAYDFVILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKYYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPIDTDVKLKLIEELFKKKTKVTLKSIRDYMIRNNFADKEDFDNSEKNLEIVSNMKSYIDFNNILGDKFELEMVEDLIEKITIHTGNKKLLKKYIEETYPDLSSSQIQKIINLKYKDWGRLSRKLLDGITGTNIETGEIDTVINFLRNSSDNLMQIIGSQNYSFNNDIDKLRKKYIPQEISYEVVENLYVSPSVKKMIWQVIRITEEITKVMGYDPDKIFIEMAKSEEGKKTTISRKNKLLALYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYKKSKIIPVKAILASDLRKDMNTLKSREVNDLHHAHDAFLNIVAGDVWNREFTSNPINYVKENREGDKVKYSLSKYFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 220 - protein, 1516 aa, Flavobacteriaceae bacterium
  Flavobacteriaceae bacterium S85
MLKQQKDKIIGMNKKILGLDLGTNSIGWALVKQDLENKYGEIIGCGSRIIPMSQDVLGKFDAGISISQTAERTNYRSVRKLIQRNTLRRERLHRVLHQLDFLPKHYNDSIDFEKKLGQFKTDKETKLNYFVNQHGKHEFLFKDSFNEMVKEFKEEQPELFYIKNNGKETKIPYDWTIYYLRKKALSKKISKEELSWLVLNFNQKRGYYQLRGEIDEEKEKNKRYEKLYVSEVVKTNNTIKKTGEYLYDIYFDNGWKYEKQTTKPQDWLHKHKEFIITTTTLKNGETKRTFKTVDSEKDWIAIKSKTEQDIKESNKTVGAFIYDTLLKNPTQKIRGSLVKTIERKFYREEFEKILKEQIKHRPEINVNTAIGKENYTKCVTELYPRNEAHANNILTNDFNYLFTKDILFYQRPLKSKKSEIANCQYEYRTYIKKKEKTGKEERVKQPLKATPKSHPLFQEFRLWQFIHNLKIYIRETTVGNKPLFDVDITDTFFTSENDWATLFEYLNNKKEIEQKHVLEYLVSKKIISKSEKTDYRWNYVEDKKYPGNETRVDFINRLKKVENLNVDEFLTSELEFKLWHIIYSVTDKNEYEKALENFAIRQNIDKDSFVNSFKKFPPFKSDYGAYSTKAIKKLLPLMRLGKFWDGSEIPKVVVEKITDIKTRLTSVNYDESLFKKDEKKILETIVDDITPKQLLKSFVKLKGKNHLAGLNTYQACYLVYERHSESSDITQWENPDDIDSFLNHFKQHSLRNPIVEQVVTETLRTVRDIWKYYGNGSPNYFNEIHIELGREMKNPADKRKQMSAKINENENTNQRIKGILQELMNDGVQDIKPYSPSQQEILKIYEEGISQNPNVDYSKVSEDEITKIKKSNNPTLKEIQRYKLWLEQKYISPYTGKPIPLSELFTPAYQIEHIIPQSRYFDNSLSNKIICESEVNEDKSNKTAYEYLKTNGGSIVHGHHLLSLKEYEDHCQHYFKKNRTKLKNLLSEEIPEGFINRQLNDSRYISKLIKGLLSNIVREENEQEATSKNIVPVTGSITSKLKQDWGLNDKWNEIIAPRFKRLNKMTNSNDFGYFDEKINTFRIQVPDAISRGFNKKRIDHRHHTLDALVIACCTKKHIQYLNSLNNEIIKHELKPSILIKNAQGDYTKHFMLPWNNFPIDCKNAIENTIVSFKQNLRVINKTSNKYQSYKDENGNLRLGKDGKPKKGLTKQTKGNNWAVRKAMHEDTFYGEIVDGENKGKLKIKTLLDTSFDVKKIEDKVLDKSIRTILINYLKQDKYKNLSKPHEEAFSPNGIIEMNKNIISLNNNIPHKPIKRVTLKHEKGKKFSIKTLLDKKTKFAKSATGTNVFFCIYKNINGKIKYHTPSFEEIIEIQKQEFEIKYKSKLNVPETLFDKKESFELLFYLQPNDLVYLPNDEELKNRQLIDFNNLNKKQIKRIYKFTDGSGTTANFIPYQVAKVIFNLNKKEQAKSSFKYPIQNEFGVGSPQSKNQKSIEGILIKERCIKLKIDRLGNISKA

SEQ ID NO: 221 - protein, 1473 aa, Flavobacterium branchiophilum
MAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHNQFTAFVEGIDFKVLPSGKFEKI

SEQ ID NO: 222 - protein, 1459 aa, Flavobacterium columnare
MKFNLGLDIGTNSIGWALVNEDYENKKGKIIAAGSRIIPMTQDILDKFGSGAITETQTALRTDYRSKRKLIQRFLLRRERLHRVLNVLDFLPKHYAESIDFEKYFGKFLPNTEPKLAYNQNQFIFQNSFLEMLKEFQEKHPELLTNNKKIPYDWTIYYLRKKALNQRIEKEELAWLLLQFNQKRGYNQLRDEEEESVPNKQVEFYSLKIIDVVADQPKEGRDKRWYSINLENGWTYRRESKTPLFNWEGKTKDFIVTTDLNQDGSIKKDKEGKEKRSFRAPSEGDWTLLKKKTEKEIYESGKTLGTYIYDALLNTPDLKIKGDFIRTIDRSIYKEELQQIINKQKEYHLELNSSKLYKACLEELYPKNEIYKSALKNKDIAYLFINDILYYQRPLKAPKYNIGKCTYESRTFKKEDKKIREYIPAVAKSHPLFQEFRLWQWIKNLKIYEKLSSDNCTDFFLTNEQDFENLFEFLWNKKEIDHKGILEYLVKTKFPDLKPKQVKTKVKEYRWNYVYDHEKDESKTYPCGETYFLLKNKLDKIYNAQDDFLDKERLYNLWHIIYSVTDKKQYEKALAKFALKNHLDTKSFVNTFKRIPPFKNDYAIYSLKAIKKLLPLMRVGKYWNYDDIDPITKQKIQCIITGEENDTISTLVREKTNHFSNENDFKNLPLWLAGYIVYNSHNESSEIEKWKSPQDIDTFLKKFKQHALRNPIVEQVVTETLRVVRDIWSKKGQGKKDFFNEIHIELGKDLKNPVDKRRKLSSTNTKNESTNTRIKALLIELFTQGVENVKPNSPKHQEILKIFEEGALNSGIEIEEDIIKISNTDQPTKKQLELYILWLEHKYKSPYTGQSIPLSKLFTPNYEIEHIIPRSKYYDDNLSNKVICETEINRLKNNQLGYEFINNHEIREVTLEEGKTIRLLSPEQYWNFVTTYYAKNKAKRENLLLKELPVQMVEKQLNDTRYVSKYVMQLLSKIVRKEDGTDNGINSTNILSISGKMTRALKNDWDLNDVWNDLLLYRFERLNTITKTNLFTTYSEQKQKRMPIVPDQYAKGFHKKRLDHRHHALDAIVIACITRNHINYMNNQNIQGEKLKKNAIEKENYREILQKSRLDIRAQLCEKKYNDNDPTKYNWVFIKPWADFTENTKDILESIIPSFKQNLRIINKTVNYYEKYNENGKKVKVRQIKGDNWAIRKPLHKETISGKVHLSYKTPAKGKILTATRKVLDSSMDFKSIEKITDTGIQKILKNYLEYKKSPELAFSPEGIEELNATITKYNNGFHHKPIYKVRIYEEGVKFPLGNKGNKKSKYVEAEKGTNLFFAIYKDQENNRYFETIPFNDVLETLKKGMSAVPEKNQEENTLVFALSPQDLVFVPTLDEIENPDIVDFKNLTKDQTNRIYKMVSSSGKQCFFIKAEVATSIVNKMEFSTSNKMENSIEGIQIKSNCWKLKLDRLGTITRVIK

SEQ ID NO: 223 - protein, 1535 aa, Flavobacterium columnare
MTKILGLDLGTNSIGWAIRDTENEGINQILDKGARIFSEGVKSENGKEISRAAERTAYRSARKIKYRRKLRKYETLKVLSINGMCPLSVEEVEQWKKSGFKEYPLNPEFLDWLRTNEDKNINPYLFRDKASKQKVTLFELGRALYHIAQRRGFLSNRLDQSAEGVFEEHNPQIQNLIEDLDSSNTILNELKEYYINLGIIDETEKSGFKKDLDEGEKKLKSLYNSLVAITKKNANDIETCKQELIARLNKKEDLGKVKGKIKDISQAMLDRNFKTLGQYFFSLYNKERIRNQYTSREEHYLEEFIIICQTQGIEGINTNEKLPEKKFTGLAKDLYRAIFFQRPLKSQKGLIGKCSFEKNKSRCAVSHPDYEEFRMWSYLNTIKIGTQSEKTLRFLTLEEKLKLVPKFYRKSDFNFEVLAKELVEKGASFGYYKSSKKNEFFYWFNYKPTDSVSACVVSASLENAIGKDWKIKTFEYQTRNTEKNEVTKSVDYKDLWHLLSVATSDTYLYDFAIEKLKLEPKNAKAFSKTKLKKDFASLSLAAIAKILPYLKQGLLYSHAVFMANIENIVDADIWKDEEQQKFIQSKIVELVDNYIVEKSKLELINGLLKIYNTEDKEGRKVYYSKEAESLFEADLRKKLVPFYKANIIIEEHEQEIIFQDLFPILMDQLKKQEFIKIGRLDKQIEAFLEGENEEGQIFCNHTDKLKKLYHPSDIEVFKKKTIKDEWGNEKVVLGSPLTTSIKNPMAMRALHQLRKVLNTLIANDQIDEDTRIHIEMARELNDANKRKGIQDFQNENKKFREEAIKEIKKLYLEECHKDVNPTEDDILRYQLWLEQGKCEIYEEGNNISICDIIGSNPSYDIEHTIPRSISQDNSQMNKTLCSLKFNRSIKKQKMPVELSNYNDILPRIAHWKKEAEELTRQIETISRSIKSAATKVAKDKNIRKRHYLTLKRDYILGKYERFTWEEPKVGFKNSQIPDTGIITKYAQAYLKSYFKRVESVKGGAVAEFRKLWGIQESFIDENWWKHYKDKDRDKHTHHTIDAITIACMPKDKYDLLAHAWRLEDEQDKKAAKVLIEQAKPWKTFKEDIEKIETEILVSHFTPDNVKKQSKSIIKNRGKKVYVLKNELPVNFKNKIEGKDYFKLKFDSKILYKIPKKKEKQTDTFYEELPKNYLNGVEGKDYFKINTTGKTFYKIPIFNQGDTIRGSLHQETTYGAIKLPDIDIETKKPLHTDKGGFILKKDIKGNEIVFFVVRKEISKISENDVQNIVDNVVRKKIENAIANSLITFKIVKKKKVAVIKEGVTIWMREPNIEKGIEGIPIKKVRIITNSVKNPIEIKVHSPLSKSRHKHKQKVYGQNDENYAMALYELDGKREFELINNFNLAKLLKQSQSYYPLHKEKEIKGKKILVPIEKRNNKDVILKRGQQVVFYDKTVENPKDISEIIDFRERIYIIEGLTIQRQKDKKTSKVNEYGIIQLRHFKEARKSEEISKDNFKPDGEFKINENKPTRKMNHNQFTAFVEGIDFKVLPSGKFQKI

SEQ ID NO: 224 - protein, 1354 aa, Flavobacterium psychrophilum
  Flavobacterium psychrophilum JIP02/86
MKKILGLDLGTNSIGWAFINEAENEIEVSSIVNTGVRIVPLTTDEESDFKKGNTISINADRTLKRGARRGLQRFKQRREALLETFNRIKFIATDFVYAETGAATTFSSYQLRAKSAVEAVTKEELVKVLLMLNKKRGYKSSRKAKTAEEGDAIDGMKIAKEIFENNLTPGQWVYNSLSKGGKFIPDFYHSDLQKELEKIVRFQNQFHSEQINDKLLADIQGKSRTQTSQHFSKTLNIPLAENKGTREETKLQHYQWRNEALANELDMKILAFIITEINNQINQSSGYLGAISDRSKELYFNQETVGQYQYKQLQENVHAKLKNQVFYRQDYLDEFEKIWETQAKFHSELNEKLKAEIRDITIFYQRKLKSQKHLVSFCEFEKGHKAIPKSSPLFQEFRIWQNLNNVVVKNETTKEVFELSEELKQLIAEELQFKESMTDVQMLTFCELKKGTHTVNFKKIEGNRTNTSIYKAFEKILEVEGYEIDFSKMKPLEIKETVAPIFETLNINTVILDFDPTIQGNDFDKQPYYQLWHLLYSAEDDDKLKETLKTKFGFKENHLPFILNINLQADYGSLSAKAIKKILPHLMDGHIYDKACLMVGYNHSSSLTTAQNNDRVLKDTLELLKKNSLRNPVVEKILNQMINVINAIMKDPAMGKPDEIRVELARELKANNEQRKKATSDINTATTEHERIRKLLHSEFNIPRVTRNDIIRYKLWLETGGISLYTGNPIKASDLFSKNYDIEHIIPKSRLFDDSFSNKTLCERQLNIDKSNKTAYSFLQEKLSENDFAAYENRVKDLFKTGKIKSYTKYKKLLMADNEIPEGFIDRQLRETQYIAKKAKEILLEVSRNVTATIGSVTDKLRQDWELVDVMKELNWEKYDKLGLTHIEEGKNGERLSKIKDWTKRNDHRHHAMDAITVAFTKPAYIQYLNNLNAKTQGENKANSIIGIENKHLYRDKNNKLRFISPMKNFREEAKKQLESILISYKAKNKVVTKNKNTTKKSGGTNQKIQLTPRGRLHKETVYGKLQQYATKEEKVNASFTEDYIQKVAKKEYREALLKRLEENDNDPKKAFTGKNALNKTPIYISLKDNIIVPEKVKTVWLETDYTIRKDITPDLKIDKVIDVGIKRILQNRLNEFNGDPKKAFVNLGESPIWLNKEKGIAIKRVTISGVSNAQALHTKKDHLGNEILDKNGNPIPVDFISTGNNHHVAIYRDEKGNLQEEVVSFYDAVIRRNLGLSVINKNHEKGWEFLFSMKQNEFFIFPSDGFNPHEIDLLNPNNYHLISPNIFRVQKISTKNYMFNHHLETKAVDGEMLKSKKELSKTSYHFIQTPTNLNGIIKVRINHLGKIVHLGEY

SEQ ID NO: 225 - protein, 1458 aa, Fluviicola taffensis
MTKTILGLDLGTNSIGWALINQDFDNKKGEILGMGSRIIPMTQDIKDEFGKGNSISQTAERTRLRGVRRLIHRTLLRRERLHRVLNIIGFLPEHYANQIDFEKRFGKFKPESEPKISFDGNDVFLFEKSYQEMLVDFKIHQPQLVSNGKKIPHDWTIYYLRKKALSKKIEKEELAWILLNFNQKRGYYQLRGEEEEETPNKLVEFHSLKIVEVNADEPQKGKPEIWYSLVLENGWVYRRASKTPLFDWKDKIREFIVTTEINNDGTVKTDKEGTEKRSFRAPKPEDWTLQKKKTEFELSKSGNEVGAFIYESILQKPNQKIRGKLISTIERKFYKEELKTILKTQLFFHKELKDEKLYNACIEELYKNNEAHRSLLSNKGFEHLFINDILFYQRPLRSKKSQISNCPLEKRTYKKEGIEITEGIKVISKSNPIYQEFRLWQWISNLSLYCIEPTETNVTSTFLNSIEDYENLFEFLNNRKEIEQKHLLKYLLENQGFKGKLLTNELEKFRWNFVADKKYPCNETGSLLHTRLSKVKNISPDFLTKEIEHQLWHIIYSVTDKIEYEQALKTFARKNNLDVDSFFEHFKKIPPFESTYGAYSEKAIKKLLPLIRLGKYWNWEAIDSISKDRISKILSGEYDENIKNRVREKAVHLTSENNFQGLQEWLAKYIVYDRHSEGNDLGKWTSVSDLETYLKEFKQHSLRNPIVEQVITETLRVVKDIWIKHGKGTENFFDEIHVELGREMKNNSEDRKRLTNTITENENTNLRIKALLMEMMNDNDVENVRPYSPSQQEILKIYEDGALNSNIELDDEIVKISKKAEPTKSELQRYKLWLEQKYRSPYTGQVIPLNKLFTSEYEIEHVVPQSRFFDDSFSNKVICESAVNKRKDNQLGLQFIKNHSGEKVELGFGKVVQVFTEEQYLDFVKEHYSKNRSKHNKLLLEEIPEKMIERQLNDTRYISKFVSSILSNIVRSEKDDDGLNSKNILPGNGKITTELKRDWGLNDVWNDLILPRFERMNTITNSDLFTTYNDKYQKHLPTVPFEYSKGFQKKRIDHRHHAMDALVIACATRDHLNLMNNQSAKSELKRYDLQNKLRKKEPYFNQKENKQKEAFKDFIKPWGTFTEDSKNALEKIIISFKQNLRVINKATNSYESYKDEDGNLRIGKDGKPEKGLIKQKGLNWAIRKPLHKDTVSGQINLSRIKLPNGKILTATRKNLDTSFDLKTIENSITDTGIQKILKNYLLSKESPELAFSPEGLEEMNNEIEKYNNGKFHHPINKARIYELGSKFNVGQTGNRRDKFVEAAKGTNLFFAIYQDENKNRSYETIPLNEVIEHQKWRASLPKEEQEKIPLVPVNKLKGTFIFSLSPNDLVYVPSNDELERSASIDFSKLKKEQINRLYKMVSSSGSQCFFVKSEVATSVVNKMEYSSLNKMEKSIDNLMVKEICIKLKIDRLGNISKA

SEQ ID NO: 226 - protein, 1646 aa, Francisella tularensis
MNIKILPIAIDLGAKNTGVFSAFYQKGTSLESLDNKNGKVYELSKDSYTLLMNNRTARRHQRRGIDRKQLVKRLFKLIWTKQLNLEWNKDTQQTISFLLNRRGFSFITDGYSPEYLNIAPEAVKAILMSILDDYNGEDDLDSYLQSATENDSKIDELYNKLLQKALEFKLRKLCIDIKEDKVTTKTLKELSNTEFKLLANYLVDYDRILRTQKFSYTDKQGNLRELNYYHHDKYNIQEFLKRNIIINDVILEKLTDDLDIWNLNFDKFDFEKNLEKLENQEDKDYLQTHLHHFVFAVNKIKSEMASGGRHRSQYFQEITNVLVENNHQEGYLKNFCENLHNKKYSNLSVKNLVNLIGNLSNLELKPLRKYFNDKIHAKADYWDEQKFAETYSDWILGEWRVGAKDKDKKDGAKYSYKNLCDELKQKVGINQDGIINQTKSDFVDFLLELDPCRTIPPYLDNNNRKPPKCQSLILNPKFLDNKYPNWQQYLQELKKLQTVQNYLGNFEIDLKDLKSSKEQPYFVKYKSLNQQIASGQRDYKDLDARVLQFIFDRVKASDELLLNEIYSHAKKLKQNTSSELEKLELCKKLDEVIANSQLSQILKSQHVNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNQASKLEFDRKIKKFNSIYSFAQIQQIAFAERKGNANTCAVCSADNAHRMQQIKVAKPVEGNKDNIILSAKAQRLPAIPTRIVDGAVKKIATILARNIVDDNWDNIKQALSNNQQLHVPIITESNAFEFEPALADIKGKSLKDKRKKALERIDPENVFKDKNNRIKEFAKGISAYSDANLANGDFDGAKEELDHIIPRSHKKYGTLNDEANLICVTREDNQNRGNKAVFLYDLKPNYKLKQFNTTDDLEIEKKIADTIWDASKQDFKFGNYRSFINLTPQEQIAFRHALFLADKNPIKKAVIRAIDNRNRTFVNGTQRYFAEVLANNIYLRAKKENLATNRITFDYFGIETTNSNGRGIADVRKLYEKVDSDIQAYAKGDKPQDSYSHLIDAMIAFCVAADEHKNEGSIGLKMGNQYGLFPTPDKYDENTGEIISWHNDDIFRKIKVSDNQFSDKKLVRKKATEGFNTHRQMTRDGIYGESYLPILIHKNLNEVRKGYNWENSEEIKIFKGKKYDIQQLNNLVYCLKFVDKPISIDIQITTLEELRNILETNNISTTAEYYYINLKTQKLHEYYIENYNTALGYKKYTKEMEFLRSLAYRTERVKIKSIDDVSMILAKDSNFKAGKIELPFKTEWQRLYLEWQNTTIKDNHEFLKSYFSVKNATKQHKKVRKDFSLPISTNEGKLLVKRKTWDNNFIYQILNDSDSRADGTKPFIPAFDISKNEIVETIIKSFTSKNIFWLPKNIELQKVDNKSIFAIDTSRWFEVETPKDLIEIGVSTIQYKIDNNSRPKVRVKLDYVMDDDSKINYFMNHSLLKSRYPDKVLEILKQSTIIEFESSGFNKTIKEMLGMTLAGIYNETSNN

SEQ ID NO: 227 - protein, 1629 aa, Francisella tularensis
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSEILKTQKFSYTDKQGNLKELSYYHHDKYNIQEFLKRHATINIQILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLESFETDLKVLKSSKDQPYFVEYRSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAITTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLANNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKATEGFNTHRQMTRDGIYAENYLPILIHKELDEVRKGYTWKNSEEIKIFKGKKYDIQQLNNLLYCLKFVDKPISIDIQISTLEELRNILTTNNIAATAEYYYINLKTQKLHEYYIENYNTALGYKKYTKEMEFLRSLAYRSERVKIKSIDDVKQVLDKDSNFIIGKITLPFKKEWQRLYREWQNITIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 228 - protein, 1629 aa, Francisella novicida
  Francisella novicida FTG
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTTIEFESSGFNKTIKEMLGMTLAGIYNETSNN

SEQ ID NO: 229 - protein, 1629 aa, Francisella novicida
  Francisella novicida GA99-3548
MNFKILPIAIDLGVKNTGVFSAFYQKGTSLERLDNKNGKVYELSKDSYTLLMNNRTARRHQRRGIDRKQLVKKLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDLDIWNFNFEKFDFDKNEEKLQNQEDKDHTQAHLHHFVFAVNKIKSEMASGGRHRGQYFQEITNVLDENNHQEGYLKNFCENLHNKKYSNLSVKNLVNLIGNLSNLELKPLRKYFNDKIHAKADHWDEQKFTETYCHWILGEWRVGLKDQDKKEGAKYSYKDLCNELKQKVTNAGLIDFLLELDPCRTIPPYLDNNNRKPPKCQSLILNPKFLDNQYPNWQQYLQELKKLQIIQDYLESFETDLKVLKSSKDQPYFVEYKSSNQQIASGQRDYKDLDARILQFIFDRVKASDELLLNEIYFQAKKLKQKASSELEKLESSKKLDEVIANSQLSKILKSQHTNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRDDNKNKGNRIFCLHDLANNYKLKQFETTDDLEIEKKIADTIWDASKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQVYAKGDKPQASYSHLIDAMLAFCIAADEHRNDGSIGLEIDKNYSLYPLDKNTGEVFTKDIFSQIKITDNEFSDKKLVRKKATEGFNTHRQMTRDGIYAENYLPILIHKELDEVRKGYTWKNSEEIKIFKGKKYDIQQLNNLLYCLKFVDKPISIDIQISTLEELRNILTTNNIAATAEYYYINLKTQKLHEYYIENYNTALGYKKYTKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 230 - protein, 1629 aa, Francisella tularensis; identical to SEQ ID NO: 30

SEQ ID NO: 231 - protein, 1629 aa, Francisella novicida
  Francisella novicida GA99-3549
MNVKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSEILKTQKFSYTDKQGNLKELSYYHHDKYNIQEFLKRHATINDEILDTLLTDDLDIWNFNFEKFDFDKNEEKLQNQEDKDHTQAHLHHFVFAVNKIKSEMASGGRHRGQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLESFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSIKDRRKKALERISPENIFKDKNNRIKEFAKGISAYSGDNLASGDFDGAKEELDHIIPRSHKKYGTLNDEANLICVTRDDNKNKGNRIFCLHDLANNYKLKQFETTDDLEIEKKIADTIWDASKKDFKFGNYRSFINLTPQEQKAFRHALFLADENPIKQAVIRAINNRNRTFVNGTQRYFAEVLANNIYLRAKKENLNTDKISFDYFGIPTIGNGRGIVEIRQLYEKVDSDIQAYAKGDKPQASYSHLIDAMLAFCIAADEHRNDGSIGLEIDKNYSLYPLDKNTGEVFTKDIFSQIKITNNEFSDKKLVRKKATEGFNTHRQMTRDGIYAENYLPILIHKELDEVRKGYTWGNSEELKIHKGKKYDIQQLNNLVYCLKFIDKSISIDIQISTLEELRNILTTNNIATTAEYYYINLKTQKLHEYYIENYNTALGYKKYTKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 232 - protein, 1323 aa, Fructobacillus fructosus
  Fructobacillus fructosus KCTC 3544
MVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 233 - protein, 1374 aa, Fusobacterium nucleatum
  Fusobacterium nucleatum subsp. vincentii ATCC 49256
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 234 - protein, 1367 aa, Fusobacterium sp.
  Fusobacterium sp. 1_1_41FAA
MKKQQFSDYYLGFDIGTNSVGWCVTDFNYNVLRFNKKDMWGSRLFDEAKTAAERRVQRNSRRRLKRRKWRLNLLEEIFSDEILKIDSNFFRRLKESSLWLEDKSSKEKFTLFNDDNYKDYDFYKQYPTIFHLRNELIKNPEKKDIRLVYLALHSIFKSRGHFLFEGQNLKDIKNFETLYNNLMAFLEDNDIYKNIDSSYIGNLENIICDSKKGLKDKEKEFKEIFNSDKQLVGFFKLSVGSSVSLNDLFDTDEYKKGEVEKEKISFREQIYEDDKPIYYSILGEKIEFLDIAKSFYDFMVLNNILADSQYISEAKVKLYDEHKRDLKNLKYIIRKYNKENYDKLFKDKNESNYSAYIGLNKEKGKKEVIEKSRLKIDDFAKIIKGYLPKAEKIDEKDRSIFNEILDKIELKTILPKQRISDNGTLPYQIHEAELEKILENQAKYYDFLNHEENGISTKDKLLMTFKFRIPYYVGPLNSYHKNKGGNSWIVRKEEGKILPWNFEQKVDIEKSAEEFIKRMTNKCTYLNGEDVIPKDSFLYSEYIILNELNKVQVNDEFLNKEIKKKIIEDLFKKSKKISEKNFREYLLVNQITNKTVELKGVKDAFNSNYVSYIKFKDIFGDKLNLDIYKEISEKSILWKCLYGDDKKIFEKKIKSVYGDILTKDEIKKINSFKFNTWGRLSEKLLTEIEFIDLETGECYSSVMDALRRTNYNLMELLSSKFTLQENIDNENKEVSEFSYRDLVEESYVSPSLKRAILQTLKIYEEIRKITGRIPKKVFIEMARGGDETMKNKKIPARQEQLKKLYDSCGKDISNFSIDIKEMKNSLNSYDNNSLRQKKLYLYYLQFGKCMYTGKEIDLNRLLQNNDTYDIDHIYPRSKVIKDDSFDNLVLVLKNENAEKSNEYPLKKEIQEKMKSFWKFLKEKNFISDEKYKRLTGKDEFELRGFMARQLVNVRQTTKEAGKILQQIEPEIKIVYSKAEIASSFREMFDFIKVRELNDTHHAKDAYLNIVAGNVYNTKFTEKPYRYLQEIKENYDVKKIYNYDIKNAWDKEKSLEIVKKNMEKNTVNITRFIKEEKGQLFDLNPIRKGETSNEIIAIKPKFYEGSTEKLNEKYGYYKSLNPAYFIYVEHKEKNKIIRSFERVNLVDVNKIKDEKSLIKYLIENKGLIEPKVIKKVYKRQVILINNFPYSIVALDSNKLMDFENLKPLFLERKYEKILKNAIKFLEDNQGKTEEYYKFLYLKKKDRNEKNETIDSVKERYNIEFNEMYDKFLEKLDSKDYKNYINNKKYSELVNVKEKFIKLNLFDKAFTLKSFLDLFNRKTMADFSKVGLTKYLGKIQKISSNVLSKNELHLLEESVTGLFVKKIKL

SEQ ID NO: 235 - protein, 1367 aa, Fusobacterium sp.
  Fusobacterium sp. 3_1_27
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIKKLEKIICDSGKGLKDKEKEFKEIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKGKKEVVEKSGLKIDDLIKVIKGYLPKPERIEEKDKIIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNGNKEMNEVSYRDLIEESYVSPSLKRAILQTLKIYEEIKKITGRVPKKVFIEMARGGDETMKNKKIPARQEQLKKLYDSCGNDIANFSIDIKKMKSSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMKKNTVNITRFIKEEKGQLFDLNPIKKGETSNEIISIKPKLYNGKEEKLNEKYGYYKSLNPAYFLYVEHKEKNKRIKSFERVNLVDVNNIKDEKSLVKYLIENKKLVEPRLIKKVYKRQVILINDYPYSIVALDSNKLMDFENLKPLFLENKYEKILKNVIKFLEDNQGKSEENYKFIYLKKKDRYEKNETLESVKDRYNLEFNEMYDKFLEKLDSKDYKNYINNKKYKNLLDVKEKFIKLNLFDKAFTLKSFLDLFNRKTMADFSKVGLTKYLGKIQKISSNVLSKNELYLLEESVTGLFVKKIKL

SEQ ID NO: 236 - protein, 1367 aa, Fusobacterium sp.
  Fusobacterium sp. 3_1_36A2
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIKKLEKIICDSGKGLKDKEKEFKEIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKGKKEVVEKSGLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNGNKEMNEVSYRDLIEESYVSPSLKRAILQTLKIYEEIKKITGRVPKKVFIEMARGGDETMKNKKIPARQEQLKKLYDSCGNDIANFSIDIKKMKSSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMKKNTVNITRFIKEEKGQLFDLNPIKKGETSNEIISIKPKLYNGKEEKLNEKYGYYKSLNPAYFLYVEHKEKNKRIKSFERVNLVDVNNIKDEKSLVKYLIENKKLVEPRLIKKVYKRQVILINDYPYSIVALDSNKLMDFENLKPLFLENKYEKILKNVIKFLEDNQGKSEENYKFIYLKKKDRYEKNETLESVKDRYNLEFNEMYDKFLEKLDSKDYKNYINNKKYKNLLDVKEKFIKLNLFDKAFTLKSFLDLFNRKTMADFSKVGLTKYLGKIQKISSNVLSKNELYLLEESVTGLFVKKIKL

SEQ ID NO: 237 - protein, 1391 aa, Galbibacter sp.
  Galbibacter sp. ck-I2-15
MKTILGLDLGTNSIGWALVKEAENENEVSDIIKLGVRVNPLTVDELTNFEGGKAYSNNAERTLKRGARRNLQRYKLRRENLIEILLKNGLINKDTALTEVGKETTHQTLKLRSKSANEKVSLEDLAKILLSINKKRGYKSSRKVNAEDDGVAIDGMEVAKLLYDENMTPGEYVLRLLESGKKHLPDFYRSDLQEEFNLVWKKQSEFYPLILTKELFFELHGKNKSQTWAICKEPLGIVGVKLKGSAKEQKFARYRLRKEALTQQIELEHLAIVLQDINNDSNKSSGYLGAISDRSKELFFNKETVGQYQYKQLQKDPNTSLKNQVFYRQDYLDEFEVIWRNQAKFYPQLTNELKQEIRDVVIFYQRKLKSQKNLISFCQFESTQQNYVEKETGKTKIRTIGRRVIPRSSPLFQEFKIWQSLNNLKFVNSESNQIIQFIELEDDVKKVVFDELNLRGDLKPNQVLKILSKYMKIGKLTQWKCNLEEIEGNRTNSALYNVFQMIAEEEGYGFNWGKKSALEIKSELKAIFSSIGINDSILDFDFSKKLDQQLSYQLWHLLYSAEEGNSKITEEDKFTYGNTGVALKKKLHLKFGFKPEYSTLISNLRFTSDYGNLSSKAISKILPFLRDGSDYSKACQYAGYNHSNSLSADELDNRELKPKLELLKKNSLRNPVVEKILNQMVNVVNQVIDNYGKPDEVRIELARELKKSAKERSQMTKNISDATRRNAEIKKYLSKEFGIPNPTKGDVIRYRLWEELASNGYKDLFRDKYIPKEKLFSNEIDIEHIIPKALLFDDSFSNKTLAFKVDNLKKADRTAFDFMSTDFSKDVDSYIGRIETLHKDGKISSSKYKKLMIPKSKLVDGFIERDLRNTQYIAKQARKMLLEVFKTVVPTTGKITDKLREDWDLINVMKELNFPKYKALGLTKKIERFDVGSEKIKSINVIEGWSKRNDHRHHAMDALAVAFTTHNHIQYLNYLNARKDIHHEMHGTIKSIENQIIGKDVMGKRRFIPPISDLRMKAKLQIESILISFKNKNKVVTWSVNKTKLKGKDNYNKRRQLTPRGQLHKETVYGKIKLIDPKPLKLNNKFTLVRASMIVDKVHREIVLQHLSKYDNNSEVAFDSKTIKIDPILIEGIGLKEVVCYEDVFKIRKKISGDNFKNEKHLEKVIDEKVKQILKDRVIKFQGNFKEAFSNLEENPIWLNKSKGIAVKSVAIKGVNNAESLHEGKDHFGDQILDKNKKQIPVDFVSTGNNHHVGIYEDKDGNLQERVVSFFEAVTRVNEGLPIIDKTYNSDIGWKFKFTMKQNEMFVFPSDDFDPNEFDLTDGKNAAKISPNLYRVQKIATKNYMFRHHLETVVTNDLEFTYKSIRSTGWLRNLVKVRINHLGEIVYVGEY

SEQ ID NO: 238 - protein, 1025 aa, Unknown
  Description of Unknown: gamma proteobacterium HdN1 polypeptide
MGGYMPQLMRYRLALDIGSTSIGWAMIRLSMQNEPIAIIRMGVRIFSDGRNPKDGSSLAVTRRVARQMRRRRDRLLKRKTRLLNALVQKKFFPEDADARKALVVLNPYELRKEGLYRQLSGPEFGRALFHISQRRGFLSNRKTDKKDNDSSVLKKAIVDLRQQLEVENCQTIGEWLFKQQQSGKSVRARLRGKTQKDKAYDFYIDRAMIAHEFDTLWVSQAKYDPLLFNEDARAILRDILLYQRPLKPVKPGRCTLIPDESRAPLALPLTQQARIYQELNHLRITTPALGAQALTVAQRNTIAALLEKSDVTFVKIAKALGLTSTTEFNLQDIKRDRLKGNATAIILARNQYFGRRWHDFNADLQNLIVDKLVNEGSETALIEWLKANTDVDESAAERVSGVTLPEGYGSLSVAALRRLLPALKEDVVVYSEAVKRAGFDSHSALSLIEQTGELYQELPYYGEVLQRHVGFGSGDPNDSPERRFGKIANPTVHIGLNELRKIINALIKRYGNPAEVVVELARDLKLSREKRKEIQEEQKQRQDRNEKRIKDACEILGIDPLVIDRGKRREISQKMQLWDELNPKDAANRRCPYTGDQISIEKLLSAEVEIEHILPFSKTLDDSLNNKTVAMRRANRDKGNRTPYEAFGESLNPDYDYDAILQRASLMPREKRKRFASDGYQQWLRDDKDFLSRALNDTAYLSRIAKEYLTLICPPNSVRAIPGRMTAQLRAMFGLNRLLSEGGIKNREDHRHHAIDAAVIGVTDQGLLQKFSRASARTRELQLSRLVDDMPLPWDTYREHVTRALEHLVVSHKPDHGYQGKMHEDTAWGLRDNGQVTRRVRSEDGGPRQRLLENKNVVKINSTRDFSRHGIDEQGQVNAYKGYVGGSNYCIEIWIDEKGKWNSDVVSTFQAYQIVRELGEKAAWQKLRNPLLSLSAKPLVMRLIIDDVVKMQIAGQNKIMRVVKIAQNGQIFFAEHNEANVDARDKDKNNPFKYISKTAGSLQKAGGIHMAISPIGDARPVRYGR

SEQ ID NO: 239 - protein, 1397 aa, Unknown
  Description of Unknown: gamma proteobacterium HTCC5015 polypeptide
MTKNYISPIAIDLGAKFTGVALYQYLEGADCTQEVAKGLLVDDRGNVTWSQEGRRGKRHQVRGYKRRKMAKRLLWLILDSEYGIKREEVTEPLLKFINGLLNRRGYTYISEEVDEESMNVSPLPFSEMMPDYFNSSAPLLEQLAKLLSDKNKLVRFRAEGKIPSNKNEFKKLLDTALDGKYKDEKKELSEAWGNILIASENVLKSTVDGHKSRSEYLANIKEDIKSNEELEKQISSKEIDGFYNLVGHLSNFQLRLLRKYFNDPNMSGVSYWDEKRLEKYFYQWVQGWHTKGGTDEAEKKNIILKTKGAPLLKTLKSLSADLTIPPYEDQNNRRPPKCQSVLLSDEKLTMHYPKWKEWVGQLVKQNDNAYLNENVTLANALHRIVERSRSIDPYQLRLLISITDAEKRNDLAGYKRLKLSLGSEVDEFLLLVKNIVDETKEAREGLWFETENKLFFKCGKTPPRKEKLKSTLLSAVLGKNLSDDEQSSFIEEFWKSGTPKIERRNVRGWCRLASQVQKTYGVYLKEYGLQQLHKLEAGKKLDDKPLALLYKNSGLIASKIGEALNIEPDEVSRFASPHSLAQIFNIIEGDVAGFNKTCRACTYENIWRMQEEKVESLLTNQLLSEIHGERKVPLKSAMCTRLSADSTRPFDGQMASIIEHIARKIAQHKIAQINDVPKEFSIDIPIIIESNQFSFTAELEEIKRGRGSAKAKKAKELGEKSKAGWVSKTERIKTSSEGICPYTGAPLGGSGEIDHIIPRSLTGRTKKTVFNSEANLIYCSSKGNHDKGNRVYVIEQLNDKYLKKQFSTSDVNLIKKKIKTTIQRFTEGGEKLRSFSELSREDQKAFRHALFVPELKSEVTSLLAVKNITRVNGTQAWLAKKIASLLAEHLDKQGRDYTLSAHQIDPWSVSKQRKMLASAEPIWAKKDPQPAASHVVDAVCTFLEALEQPHTASRLKTISSTSFEKTGWRSALIPDLIKVDALDRRPKYRRYNIGSTSLFKDGIYAERFLPILIDENGLMAGYDIDNSLKAKGADVVFESLSPFLLFKGEEVGAQSLSDWQERIDGRYLYMSIDKVKAFDYLQEKVGEKDIAAELLNSIHFTQRKTELRAKFSDDSGKKMKTLDAIRKSLKLTVTVNEIGKRKEKCGFSGTIGIPAKSAWENLLDEPLLETYWGTKMPPQEIWEKVYRKHFPRNIPNQAHRKVRKDFSLPVVDSVSGGFRVKRKTPNGYNYQLLAIDGYSAVGFKKEGDNVDFKSPALVPQIAESKSVTPISSELVHLDKNEIVYFDEWRKIDISDSDLKQFVSSLELAPGSQNRFYIRFTVDEDQFERHFKSALRVNGIQDLDTVNKTFDWNREIPSLLIPPRSNLFLLETGQKITFEYIANGANAEVKKAYSLRRA

SEQ ID NO: 240 - protein, 1186 aa, Gardnerella vaginalis
  Gardnerella vaginalis 1500E
MEGNISYAIGIDVGLNSVGLAAIRLDNNGEPIRILKAMSVIHDAGIDPNGAKESDTRKAISGVARRVRRLYRQRRRRLQKLDFLLHSLGFPVVENKDLDFSDSFIPWIFRAKLADEYIADEKQRKQMLSVAIRHIARHRGWRNPYQSIKSMTQETEYSEFYNELLKNIEKFAPGVGCEGSTPAQLVRDYLLLQQGKASRRLRITTDEKRKNHPNSLNPILPRKLMQSDNMLEILNIFNVQHIDDKYVREQIINAVFYAKSPRGSAENRVGKDAITGKGKRALKASLAFQKYRIISTISNLRIRENSKERCLTIEEKQSVYKLLTTSTDESSKEKSAEAPLYTWIDVADCLGIERYKLRGVGSQIGDGESVGNRPPMLNSELAIIYANNKSLGKSLLTWWLDANRTQEDKEALIEILSNTVDIEAIHDNPEYQDKYGSAIAFIDSMDETEIAALENISLPDGRAAYSLETLDKLNKQMLETDDDLFEARKKLFNLPNNWRPSEAPIAEPTGNPSVDRVLKIVHRFLISAKNRWGNPERINIEHVRSGFKSKKMANSYKELLDKRTKGKENLKAMMRNSLHLGMSDSISDADIRRYEAVQRQNGQCLYCGSEITYHTCELDHIVPRKGPGSTNTRENLVATCSLCNAQKCNTPFSTWCEQSTYCKNHDISVDSAINRVRAFIFPPNSYDKRGANQFKKEVIARLKQKVGDEAFDNRSIESVAWMANELHRRIDWYYNSQNYQTNNGISDITNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLKLLNEEMRADRIAVVNSIRLRYNNSSVHQYKVNALLKLHVGDEIDSGTIRRSSTPALYCALTRNPDYDVNNGLPENPNRAILLHDKKLNADDSITFFKAQAVQLFVREGSAEIGSSTHHLRIYEYFKKLKSGKIKKSYGMIRVFQNDLHRHIHEDLFSCDLPEQSISMRYADTEVAHAVQTGNSNYLGYLVPGDEIIVDFSHVKLSGNIGTFVEFLNKIGANCAAYNHWVVVGTDTEKVLILKPSMISSEGIDKLYSNCKRNNFDYSSYEKSINEILVGKGWRVSVNVLAKYNAETIRRNALGEVRWTSRSHLPISWSWNTGENRE

SEQ ID NO: 241 - protein, 1186 aa, Gardnerella vaginalis
  Gardnerella vaginalis 284V
MEGNISYAIGIDVGLNSVGLAAIRLDDYGEPIRILKAMSVIHDAGIDPNGAKESDTRKAISGVARRVRRLYRQRRRRLQKLDFLLQSLGWPVVENKDLDFSDSFIPWIFRAKLADEYIADEEQRKQMLSVAIRHIARHRGWRNPYQSIKSMMQETEYSEFYNELLKNIEKLAPGVGCEGSTPAQLVRDYLLSQQGKASRRLRITTGGRRKNHPHSLDPVLPRKLMQSDNMLEILNIFNVQHIDDKYVREQIINAVFYAESPRGSAENRVGKDAITGKGKRALKASLAFQKYRIISTISNLRIRENSKERCLTIEEKQNVYKLLTTSIDKSSKRKSAEAPLYTWIDVADCLGIERYKLRGVGSQIGDGESVGNRPPMLNSELAILYANNKSLGQSLITWWLASNRTQEDKEALIEILSNTVDIEAIHDNPEYQDKYGSAIAFIDSMNETEIAALENISLPDGRAAYSLETLDELNKQMLETDDDLFEARKKLFNLPNNWRPAEAPIAEPTGNPSVDRVLKIVHRFLISAKNRWGNPERINIEHVRSGFQSKKMANSYKELLDKRTEGKENLKAMMRNSLHLGTSDSISDADIRRYEAVQRQNGQCLYCGSEITYHTCELDHIVPRKGPGSTNTRENLVATCSSCNAQKCNTPFATWCEQSTYCKNHDISADSAINRVRAFIFPPNSYDKRGANQFKKEVIARLKQKVGDEAFDNRSIESVAWMANELHRRIDWYYNSQNYQTNNGISDISNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLKLLNEEMRADRIAVVNSIRLRYSNSSVHQYEVNALLKLHVGDEIDSETIRRSSTPALYCALTRNPDYDVNNGFPENPGRTILLHNKKLNADDSITFFKAQAVQLFVREGSAKIGNSIHHLRIYEYFEKLKSGKIKKSYGMIRVFQNDLHRHIHEDLFSCDLPEQSISMRYADTKVAHAVQTGNANYLGYLVPGDEIIVDFSHITLSENIGKFVEFLNKIGADCTAYRHWVVVGTDTEKVLILKPSMISSEGIDKLYSNCERNNFDYSSYEKSINEILAGKGWRVSVNVLAQYKAATIRRNALGEVRWASRSHLPISWSWDTGENRE

SEQ ID NO: 242 - protein, 1186 aa, Gardnerella vaginalis
  Gardnerella vaginalis 5-1
MEGNISYAIGIDVGLNSVGLAAIRLDNNGEPIRILKAMSVIHDAGIDPNGAKESDTRKAISGVARRVRRLYRQRRRRLQKLDFLLHSLGFPVVENKDLDFSDSFTPWIFRAKLADEYIADEKQRKQMLSVAIRHIARHRGWRNPYQSIKSMTQETEYSEFYNELLKNIEKFAPGVSCEGSTPAQLVRDYLLSQQGKASRRLRITTDDRRKNHPNSLDPVLPRKLMQSDNMLEILNIFNVQHIDNKYVREQIINAVFYAKSPRGSAENRVGKDAITGKGKRALKASLAFQKYRIISTISNLRIRENSKERCLTIEEKQSVYKLLTTSTDEYSKEKSAEAPLYTWIDVADCLGIERYKLRGVGSQIEDGESVGNRPPMLNSELAILYANAKSLKQSLITWWLAANRTQEDKEAFIEILSNTVDIEAIHDNPEYQDKYGSVIAFIDSMDETEIAALENISLPNGRAAYSLETLDKLNKQMLETDDDLFEARKKLFNLPNNWRPSEAPIAEPTGNPSVDRVLKIVHRFLISAKNRWGNPERINIEHVRSGFQSKKMANSYKKLLDKRTEGKENLKAMMRNSLHLGTSDSISDADIRRYEAVQRQNGQCLYCGSEITYHTCELDHIVPRKGPGSTNTRENLVATCSSCNAQKCNTPFATWCEESTYCKNHDISVDSAINRVRAFIFPPNSYDKRGASQFKKEVIARLKQKVGDEAFDNRSIESVAWMANELHRRIDWYYNSQNYQTNNGISDITNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLELLNEEMRADRIAVVNSIRLRYSNSSVHKDDVHALLKLHVGDEIDSETIRRASTPALYCALTRNPDYDVNNGLPENTDRTILLHDKKLNADDSITFFKSKAAQLFVREGSVEIGNSIHHLRIYEYFEKLKSGKVKKSYGMIRVFQDDLHRYIHEDLFSCDLPEQSISMRYADTKVAHAVQTGNANYLGYLVPGDEIIVDFSHVKLSGYIGEFVEFLNKIGANCAAYKHWVVAGTDDKTTLILKPSMISSEGIDKLYSNCERNNFDYASYEKSIDKILVDKGWRVSVNVLDQYKAATIRRNALGEPRWASRSHLPISWSWDTGENRE

SEQ ID NO: 243 - protein, 1392 aa, Gemella haemolysans
  Gemella haemolysans ATCC 10379
MANKTWYLGLDIGSASVGWAATDTGYKIIRKNKKRLWGVRLFEEAKTAEDRRGYRSSRRRLARRKWRLNLLEELFTSEVKKVDENFFLRLKESQYHYEDKTHKVPYAIFNDKDYTDKDYYKDYPTIYHLRSKLMTEENPDIRKVFLAIHHIIKNRGHFLLQGQSFKDGNLNNLIKELLELDILHVGFEVTEEVVDKIADISLEKKTSKDKLNDIKELYPKEKQLLEVFRLIFGGKTSLDKLFAIDEYKELDAAIKSVSFKEKIYEEVRHDYEQVLSNYIELLDLAKLVYDSIILSDIKKEGKTLSESKVELFEKHRDDLLKLKNLVKNDSKLSEDKKVELYALIFKEDKDKGTNYVNYIRKSEEGKGCNYEDFKKFLVKELAKLEESSVKTEIIKDLELEQFLPLQRTKDNSVVPYQIHKEELVKILDNAARYHSFLNEKDESGYNVREKVIQLLEFRIPYYVGPLNSSKKAKEGGFAWSVRNTGYENTPVTPWNYSKVIDESASAEKFITNLTNKCTYLKGEDVLPKSSLLYSEFALLNELNALKYDGNRISLEARNTIIEKLFKQQGKKVTKTSIKNLLKAEGYIDGKGEITGIDITVKNDLKSYRDFKKILGNKFNSEHVENIILWITLYGESRKLIKAKIESVYGEVYSKDEITKMSRLVYKDWGRFSRKLLTELVSKKLYNEETGECLNIIGAMRQNNILFMELLADRFDYSKQIVEFNKELQEDVTEIAPEILDDLYVSPAVKRSIWQTVRIVEELKKIIGCAPAKIFVETTRSNQEKKKPTDSRKKQLELAYKAVKKDVKELEKEIGTINFDVLNDRLSSVEPSKLKAKKLYLYYTQLGRCMYSEEPINISELFDNNKYDIDHIYPQSKIKDDSFTNTVLVKRESNAAKTDRYPLGSDIQTPSNRRFWKFLKEKGLISDEKYNRLVRTEEFSDEELSGFIARQLVETSQSVKAVASILGELNPETSICYSKAENVSSFRQNFGKIKKGDRDSKNNDQLIKVREINDYHHAKDAYLNVVVGNVYDTKFTRNVFNFIKDKKDGRKYSLNKVFYENVSDSKTVAWEMDKTIHQVEKVMNNNNIMVTRRTSEQKGGLFDATVYKAKVAAKAKDGVYYPLKTSNSVVKDVAKYGGYTSIGIAYYSIFEYTIVNKKGEEKITRIIPIPIYISQNIKDSTALIEFGKSQIFCRAYEKIKDFKLLYRKLCIGSKININNYQYYIGGKSDERFYYDSAIQVTLDKKSEKYLKILSKYQNWKKENKDGELWENITKENNIELYNKLVEKMNSEIFTKKKSNKYNELNSEEIRNNFIKISVEEQAKVLLEILNLLTNKKSIFDLKSIDIKAARGKISFNLTSLIQFSIIEQSITGFYEKEITIIGDKGNDMENNNS

SEQ ID NO: 244 - protein, 1385 aa, Gemella morbillorum
  Gemella morbillorum M424
MKNKTWYLGLGVGPTSIGWAATDSNYKLLRKNKKRLWGVRLFEEAKTAVDRRTFRAERRRLARRKWRISLLEELFAKEVSKNDPNFFLRLKESKYHFEDKSLMNEYILFNDKDYTDKDYYKEYPTIYHLRLSLTTEENPDIRKVYLAVHSMLKNRGHFLLQGQSFNDSNIDSVIKELLELETVKINFEVTDEVIHSLKKIALEKKNLSDKNNDVKKLYPKEKQLQEIFKLVFGGKTSLDKLYDIEEYKELDNSVKSISFKEKVYEEVRPDYEQILSNYIELLDLAKLVYDSIVLADIKKEGKTISESKVELYNKHKDDLANLKKLVKIDSKLSEDKKKEVYFTIFKEDKEKGTNYVNYTHRSQEGKSCSYEDFKKFLKKELEKLEDSPTKTTILEELDLETFLPLQRTKDNSVVPYQIHKEELVKILDNAAKYHSFLAEKDDSGYSTREKVVQLFEFRIPYYIGPLNAHHNTENGGYSWAIRKKGMESVPVTPWNFKDVIDESASAEAFVNNLKNKCAYLSGEDVLPKNSLLYSEYALLNELNALRYEGNRISVEARDVIVTKLFKEQGKKVTKKTIKELLKTEGFIDGKGEIVGIDNIVKNDLKSYRDFKKILADKFDKERVENIILWITLYGESRKLIKEKITKVYGDFYTVDEIEKMSRLTYKDWGILSRKLLTELVSEKLYNEETGECLNIIGAMRQGTILFMELLADKFDYMSQIKNHNKENKDDITEITPDILENLHASPAVKRSIWQTVRIVEELKTIIGCVPTKIFIETTKRNNAPYKVPTLNRNDLVTKYKTIREHEIFELEKELKNTLDFTLNKNRLINEEPSKLKATKLYLYYTQLGRCMYTGKKIDLGELFDNNNKYDIDHIYPQSKVKDGSFNNIVLVTKASNDMKADVFPLKSKFQTKENKIFWRFLKEKKLITEEKYNRLVRTEEFSNGELTGFITRQLVETSQAIKVISNVLRELNPETTICYSKAENVSSFRQSFGKIKEANRKAENNEKLIRVQEINDYYNAKDAYLSIVVGNVYDVKFTRNVHNFIKNNKDARRYSLNGLFYTDVKNANTIAWEMDKTVHVVEKTMNNNNILITRRTSEQKGALYDATLYKAKVAEKAKEGTYYPLKTTDSKIKDVGKYGGFTKIKIAYYSIFEYTLDGKKGKQKITRIVPIPIYISQNIKDDKALLEYAQTRLPGKDLKIKYRKLCIGSLVKINNFNYYIGGKTNNNFTFDSAVQVILDKDSESYIKELAKYLNWKKENKDGKLWESITEDKNIQLYDSLVKKMNTGIFIRKTPNKYTELLTLEVKNKFINIDIDEQVKLLLEILNLLTNKKFTSKLNEIGITASRGVCSFNLSNQSQFSIIEQSVTGVYEKEKLIIEKKKEGIL

SEQ ID NO: 245 - protein, 1003 aa, Gluconacetobacter diazotrophicus
MIDESLTFGIDLGIGSCGWAVLRRPSAFGRKGVIEGMGSWCFDVPETSKERTPTNQIRRSNRLLRRVIRRRRNRMAAIRRLLHAAGLLPSTDSDALKRPGHDPWELRARGLDKPLKPVEFAVVLGHIAKRRGFKSAAKRKATNISSDDKKMLTALEATRERLGRYRTVGEMFARDPDFASRRRNREGKYDRTTARDDLEHEVHALFAAQRRLGQGFASPELEEAFTASAFHQRPMQDSERLVGFCPFERTEKRAAKLTPSFERFRLLARLLNLRITTPDGERPLTVDEIALVTRDLGKTAKLSIKRVRTLIGLEDNQRFTTIRPEDEDRDIVARTGGAMTGTATLRKALGEALWTDMQERPEQLDAIVQVLSFFEANETITEKLREIGLTLAVLDVLLTALDAGVFAKFKGAAHISTKAARNLLPHLEQGRRYDEACTMAGYDHAASRLSHHGQIVAKTQFNALVTEIGESIANPIARKALIEGLKQIWAMRNHWGLPGSIHVELARDVGNSIEKRREIEKHIEKNTALRARERREVHDLLDLEDVNGDTLLRYRLWKEQGGKCLYTGKAIHIRQIAATDNSVQVDHILPWSRFGDDSFNNKTLCLASANQQKKRSTPYEWLSGQTGDAWNAFVQRIETNKELRGFKKRNYLLKNAKEAEEKFRSRNLNDTRYAARLFAEAVKLLYAFGERQEKGGNRRVFTRPGALTAALRQAWGVESLKKQDGKRINDDRHHALDALTVAAVDEAEIQRLTKSFHEWEQQGLGRPLRRVEPPWESFRADVEATYPEVFVARPERRRARGEGHAATIRQVKERECTPIVFERKAVSSLKEADLERIKDGERNEAIVEAIRSWIATGRPADAPPRSPRGDIITKIRLATTIKAAVPVRGGTAGRGEMVRADVFSKPNRRGKDEWYLVPVYPHQIMNRKAWPKPPMRSIVANKDEDEWTEVGPEHQFRFSLYPRSNIEIIRPSGEVIEGYFVGLHRNTGALIPTPVGPDSYVIA

SEQ ID NO: 246 - protein, 1050 aa, Gluconacetobacter diazotrophicus
MGENMIDESLTFGIDLGIGSCGWAVLRRPSAFGRKGVIEGMGSWCFDVPETSKERTPTNQIRRSNRLLRRVIRRRRNRMAAIRRLLHAAGLLPSTDSDALKRPGHDPWELRARGLDKPLKPVEFAVVLGHIAKRRGFKSAAKRKATNISSDDKKMLTALEATRERLGRYRTVGEMFARDPDFASRRRNREGKYDRTTARDDLEHEVHALFAAQRRLGQGFASPELEEAFTASAFHQRPMQDSERLVGFCPFERTEKRAAKLTPSFERFRLLARLLNLRITTPDGERPLTVDEIALVTRDLGKTAKLSIKRVRTLIGLEDNQRFTTIRPEDEDRDIVARTGGAMTGTATLRKALGEALWTDMQERPEQLDAIVQVLSFFEANETITEKLREIGLTLAVLDVLLTALDAGVFAKFKGAAHISTKAARNLLPHLEQGRRYDEACTMAGYDHAASRLSHHGQIVAKTQFNALVTEIGESIANPIARKALIEGLKQIWAMRNHWGLPGSIHVELARDVGNSIEKRREIEKHIEKNTALRARERREVHDLLDLEDVNGDTLLRYRLWKEQGGKCLYTGKAIHIRQIAATDNSVQVDHILPWSRFGDDSFNNKTLCLASANQQKKRSTPYEWLSGQTGDAWNAFVQRIETNKELRGFKKRNYLLKNAKEAEEKFRSRNLNDTRYAARLFAEAVKLLYAFGERQEKGGNRRVFTRPGALTAALRQAWGVESLKKQDGKRINDDRHHALDALTVAAVDEAEIQRLTKSFHEWEQQGLGRPLRRVEPPWESFRADVEATYPEVFVARPERRRARGEGHAATIRQVKERECTPIVFERKAVSSLKEADLERIKDGERNEAIVEAIRSWIATGRPADAPPRSPRGDIITKIRLATTIKAAVPVRGGTAGRGEMVRADVFSKPNRRGKDEWYLVPVYPHQIMNRKAWPKPPMRSIVANKDEDEWTEVGPEHQFRFSLYPRSNIEIIRPSGEVIEGYFVGLHRNTGALTISAHNDPKSIHSGIGTKTLLAISKYQVDRFGRKSPVRKEVRTWHGEACISPTPPG

SEQ ID NO: 247 - protein, 1371 aa, Gordonibacter pamelaeae
  Gordonibacter pamelaeae 7-10-1-b
MNLRNVESYQVGLDIGTGSVGWAVLDDNGDLCRFKGKPTWGSRVFPTAETAAEARVHRGQRRRYDRRRQRIDLLQRFFADEVAKVDPEFFIRLNQARLHPENRDPAHADYRWPLFNGSNFTEKDYYRQFPTIYHLRAHLLKSDEPADIRLVYLALHNIVKHRGNFLHQDNPSLSARNANVGDAVEALCLALDEWCGAHDVECACDEAALAEALGDASLRPGEKRERAEAALGVEKAHKKLAKAVSSAVVGYAAEFGHVFFAESEGSKFALSNDEKVEAYVCPDEGRDLFDAMRAVHSSYVLMGILSEAQGELLSVCKVGEYERYKRDLETLKSLVRAYGPERYDEFFCGPFYEGTRDYDPGKAQGYTKYNLGASKLSHEDFLKEVQKLLKDIGAQADERYADIERAIEAGAFLRRLKTSDNGTIPYQLHLEEMDAIIERQAAFYPFLAQEKDKLKSLVSFRIPYYVGPLTQKNAARDGKGEARFAWSSRKPGMEDARVYPWNWEDVIDKDQSAEDFIRRMTGTCTYLKGEPVLARCSLDYELFCVLNELAGARWTQDGDKSYRFDAADRLGIVEDLFKKRKRVTYEAAEKWLARTHGPESGKSAGGAYHVSGGQGEDAFESQLSSHYDFCKILGVDELSDADEAMAEDIILWNTVFEDRSILKRKIKLAYGDRLGDAQVRKLCQKRYTGWGRLSGELLRGLRSATDNGPKTIMDILLEGDPNHARRMGAAMNLMEILHDDLLEFQAKIDEHNRERALAVGGMSVDEVTGSPALRRGINQALRVVDEIAGIAGKPPAHIYVEVTRDEGARNKGRRTTSRYRALEAALSSIKAQCADVYAELKERDPRALDDERLTLYFMQCGKCMYSGDALDINKLQTYQVDHILPQSYVKDDSFENKVLVRPDTNQRKGDTLLLDERLIARMRGFWRTLRDAELIGEKKFNNLTRTSVSDEQMKKFVSRQLVETGQMVKQVQQLLQARYPESEVQPVKAGVSHQLRVGCALAKSREINDFHHAHDAYLACQVGRFVQYRHSAVYSEPVKMAAVVKQFIKKQAEDYRRTRELPGSDGFIVSSFMTPGFDVKTGEVFRDAWDAGAEIDRIRRCFDYKDCFISRMPEETHGAFWDATIYSPRAAGKTLSLPLKRGLDPRKYGSYSREQFAYFFVYEAVKPKKKQRVLEFAPVPVRVASALANDPDALEDYARELAEAEGLVFERIRRRKVYKYQQIIVGDSRLYVTGREEVRNARQLAFSQDETKLICRIEQGEECEEGELLDLFRSMQRKYLACAPRLARLMKVAEMEEGFIAATASGKREVLLSLTSIAAAHRNSIDLKPIGRKGSSGQMKITFSKELSTNGILFVDSSVTGMFERRCRLGL

SEQ ID NO: 248 - protein, 1054 aa, Haemophilus parainfluenzae
  Haemophilus parainfluenzae ATCC 33392
MENKNLNYILGLDLGIASVGWAVVEIDEKENPLRLIDVGVRTFERAEVPKTGESLALSRRLARSARRLTQRRVARLKKAKRLLKSENILLSTDERLPHQVWQLRVEGLDHKLERQEWAAVLLHLIKHRGYLSQRKNESKSENKELGALLSGVDNNHKLLQQATYRSPAELAVKKFEVEEGHIRNQQGAYTHTFSRLDLLAEMELLFSRQQHFGNPFASEKLLENLTALLMWQKPALSGEAILKMLGKCTFEDEYKAAKNTYSAERFVWITKLNNLRIQENGLERALNDNERLALMEQPYDKNRLFYSQVRSILKLSDEAIFKGLRYSGEDKKAIETKAVLMEMKAYHQIRKVLEGNNLKAEWAELKANPTLLDEIGTAFSLYKTDEDISAYLAGKLSQPVLNALLENLSFDKFIQLSLKALYKLLPLMQQGLRYDEACREIYGDHYGKKTEENHHFLPQIPADEIRNPVVLRTLTQARKVINGVVRLYGSPARIHIETGREVGKSYKDRRELEKRQEENRKQRENAIKEFKEYFPHFAGEPKAKDILKMRLYKQQNAKCLYSGKPIELHRLLEKGYVEVDHALPFSRTWDDSFNNKVLVLANENQNKGNLTPFEWLDGKHNSERWRAFKALVETSAFPYAKKQRILSQKLDEKGFIERNLNDTRYVARFLCNFIADNMHLTGEGKRKVFASNGQITALLRSRWGLAKSREDNDRHHALDAVVVACSTVAMQQKITRFVRFEAGDVFTGERIDRETGEIIPLHFPTPWQFFKQEVEIRIFSDNPKLELENRLPDRPQANHEFVQPLFVSRMPTRKMTGQGHMETVKSAKRLNEGISVIKMPLTKLKLKDLELMVNREREKDLYDTLKARLEAFNDDPAKAFAEPFIKKGGAIVKSVRVEQIQKSGVLVREGNGVADNASMVRVDVFTKGGKYFLVPIYTWQVAKGILPNKAATQYKDEEDWEVMDNSATFKFSLHPNDLVKLVTKKKTILGYFNGLNRATGNIDIKEHDLDKSKGKQGIFEGVGIKLALSFEKYQVDELGKNIRLCKPSKRQPVR

SEQ ID NO: 249 - protein, 1052 aa, Haemophilus sputorum
  Haemophilus sputorum CCUG 13788
MKNTSLNYVLGLDLGISSVGWAVVEIDEKENPLSLIDVGVRTFERAETQKGESLALARRLARSARRLTQRRVARLKKAKRLLKSENILLSTDECLPHQVWQLRVEGLERKLERQEWAAVLLHLIKHRGYLSQRKNESKSENKELGALLSGVANNHKLLQQTTYRTPAELAVKKFEVEEGHIRNQQGSYTHTFSRLDLLSEMELLFSRQQHFGNPFTSEKLLENLTALLMWQKPALSGDAILKMLGKCTFENEYKAAKHTYSAERFIWITKLNNLRIQENGLERALNDNERLALMKQPYEKAKLTYAQVRSILNLSDEAIFKGLRYSGEDKKTSETKTVLMEMKAYHQIRLALEKNDLKTEWAELKVNSSLLDEIGTAFSLYKTDEDISTCLAGKLSQPVLNALLENLNFDKFIQLSLKALHKILPLMQQGLRYDEACAEIYGDHYGKKTEENHLLLPQIPADEIRNPVVLRTLTQARKVINGVVRLYSSPARIHIETGREVGKSYQDRRELEKRQEENRKQREKAISEIKTLFPNFSGEPKAKDILKMRLYYQQNAKCLYSGKPLELHRLLEQGYVEIDHALPFSRTWDDSFNNKVLVLANENQNKGNLTPFEWLDGKNNSERWKAFKALVETSAFPYTKKQRILSQKLDEKGFIERNLNDTRYVARFLCNFIADNMHLTGEGKRKVFASNGQITALLRGRWGLAKSREDNDRHHALDAVVVACSTVSMQQKITRFVRFEEGNVFTGERIDRETGEIIPLHFPAPWKFFREEVEIRIFSDNPKLELENRLIARPQANHEFVQPLFVSRMPTRKMIGQGHMETIKSAKRLNEGLSVIKMLLTKLRLKDLESMVNREREKELYEALKARLEAFNDEPAKAFAEPFMKKGGAIVKSVRVEQVQKSGVLVRDGNGVADNASMVRVDVFTKGGKYFLVPIYTWQVAKGILPNKAVIQGKNEEDWEVMDDATFRFSLHQNDLVKLVTKKKTIFGYFNGLNRATGNIDIKEHDLEKSKVKDGIHQSIGIKLALSFEKYQVDELGKNIRLCKSSKRQAVR

SEQ ID NO: 250 - protein, 1052 aa, Haemophilus parainfluenzae
MENKNLHYILGLDLGIASVGWAVVEIDEKENPLRLIDVGVRTFERAETQKGESLALSRRSARSARRLTQRRVARLKKAKRLLKSENILLSTDERLPHQVWQLRVEGLDRKLERQEWAAVLLHLIKHRGYLSQRKNESKSENKELGALLSGVASNHELLQQATYRTPAELAVKKFEVEEGHIRNQQGAYTHTFSRLDLLAEMELLFSRQQHFGNPFASEKLLENLTALLMWQKPALSGEDILKMLGKCTFEDEYKAAKNTYTAERFVWITKLNNLRIQENGLERALSDNERLMLIEQPYEKAKLTYAQVRSILNLSDDAIFKGVRYSGEDKKAIETKTTLMEMKAYHQIRKVLEGNNLKAEWVALKANPTLLDEIGTAFSLYKTDEDISAYLAGKLSQPVLNALLENLSFDKFIQLSLKALYKLLPLMQQGLRYDEACREIYGDHYGKKTEETHHFLPQIPADEIRNPVVLRTLTQARKVINGVVRLYGSPARIHIETGREVGKSYKDRHELKKRQEENRKQREKTISEIKTLFPNFSGEPKGKDILKMRLYYQQNAKCLYSGKPLELHRLFEQKYVEVDHALPLSRTWDDSFNNKVLVLANENQNKGNLTPFEWLDGKNNSERWRTFKALVETSAFPYAKKQRILSQKLDEKGFIERNLNDTRYVARFLCNFIADNMHLTGEGKRKVFASNGQITALLRRRWGLAKSREDNDRHHALDAVLVACSTVAMQQKITRFVRFKAGDVFTGERIDRETGEIIPLHFPTPWQFFKQEVEIRIFSDNPKLELENRLPDRPQANHEFVQPLFVSRMPTRKMTGQGHMETVKSAKRLNEGISMIKMPLTKLKLKDLELMVNREREKDLYDALKTRLEAFNDDPAKAFAEPFMKKGGAIVKSVRVEQVQKSGVLVRQGNGVADNASMVRVDVFTKDGKYFLVPIYTWQVAKGILPNKAVIQGKDEEDWEDIDDATFQFSLHPNDLISVKTKKDEFLGYFNGLNRHTGGINIRTHDLEKSKGKQGIFEGIGVKIALSFEKYQIDELGKNIRLCKPSKRQPVR

SEQ ID NO: 251 - protein, 1052 aa, Haemophilus sputorum
  Haemophilus sputorum HK 2154
MKNTSLNYVLGLDLGISSVGWAVVEIDEKENPLSLIDVGVRTFERAETQKGESLALARRLARSARRLTQRRVARLKKAKRLLKSENILLSTDECLPHQVWQLRVEGLERKLERQEWAAVLLHLIKHRGYLSQRKNESKSENKELGALLSGVANNHKLLQQTTYRTPAELAVKKFEVEEGHIRNQQGSYTHTFSRLDLLSEMELLFSRQQHFGNPFTSEKLLENLTALLMWQKPALSGDAILKMLGKCTFENEYKAAKHTYSAERFIWITKLNNLRIQENGLERALNDNERLALMKQPYEKAKLTYAQVRSILNLSDEAIFKGLRYSGEDKKTSETKTVLMEMKAYHQIRLALEKNDLKTEWAELKVNSSLLDEIGTAFSLYKTDEDISTCLAGKLSQPVLNALLENLNFDKFIQLSLKALHKILPLMQQGLRYDEACAEIYGDHYGKKTEENHLLLPQIPADEIRNPVVLRTLTQARKVINGVVRLYSSPARIHIETGREVGKSYQDRRELEKRQEENRKQREKAISEIKTLFPNFSGEPKAKDILKMRLYYQQNAKCLYSGKPLELHRLLEQGYVEIDHALPFSRTWDDSFNNKVLVLANENQNKGNLTPFEWLDGKNNSERWKAFKALVETSAFPYTKKQRILSQKLDEKGFIERNLNDTRYVARFLCNFIADNMHLTGEGKRKVFASNGQITALLRGRWGLAKSREDNDRHHALDAVVVACSTVSMQQKITRFVRFEEGNVFTGERIDRETGEIIPLHFPAPWKFFREEVEIRIFSDNPKLELENRLIARPQANHEFVQPLFVSRMPTRKMTGQGHMETIKSAKRLNEGLSVIKMLLTKLRLKDLESMVNREREKELYEALKARLEAFNDEPAKAFAEPFMKKGGAIVKSVRVEQVQKSGVLVRDGNGVADNASMVRVDVFTKGGKYFLVPIYTWQVAKGILPNKAVIQGKNEEDWEVMDDATFRFSLHQNDLVKLVTKKKTIFGYFNGLNRATGNIDIKEHDLEKSKVKDGIHQSIGIKLALSFEKYQVDELGKNIRLCKSSKRQAVR

SEQ ID NO: 252 - protein, 1338 aa, Helcococcus kunzii
  Helcococcus kunzii ATCC 51366
MQDYYLGLDIGTNSVGWAVTDENYNLLRKKGKDLWGVRLFKEAQPATERRGHRSSRRRTIRKSLRKQLLRELFEEEINAIDKDFFLRLDESKYWLEDKKIEGKYSLFNDENFTDKDYYEKFPTIFHLRKALIESDDKEDIRLYFLAINQMMKRRGHFLIDGKLSNVEDITPFKECIQNLINEELDTEIETEFYDKAIKIVSDYSLKKTEKKNLIKDLVKETDSIEDSKKIINIFNLLISGKSKVNGIFDDEEILEKIKEDNKEDFYLTSEKYEENLEYFSQLLDYRFELISSLKSIYDYIILQEVLKGKKYLSYAQVERYKNHKEDLRKLKQLIKKYDKNGKIYYQIFRDENFKKGYVAYLGYYKKNKKNVPVKKCDYDTFSKNIKSTLDKICDKEDPLYIELIDKIEKGGFLLKQIVSTNSVIPHQVHELELDKILENLEKNYPSFKEISDGVSKIDKIKMIFNFRIPYYVGPLNDYHKDKVNSNTWIVKNEGFENENIRPWNFSKIVDEHACEEEFIKRMINECSYIPGEKVLPKSSLLYSEYMVLNELNNLRVNGDKLNPKIKKEIVENIYKKERKVTLKKIRNFLIINNYVDSKVEFSGLSDGIKANMSSYIDFAEILDDNFDNNMVEDLIEQITIHVGNVKLLTEKISNKYPNLEKKQINKIVNLKFKDWARFSRKLLVGIEGTEKETGEINTIIGFLRETNENFMELMSNRYTFSEEISEIKKKYIPNKLSKQIVDDLYVSPAVKKMIWQVLNINDELIKVLGKQPKKIFIEMARGKEEKPEVKDSRKNKLIELYKNLGKEGKEWLNRIEDKTEADFRNRALYLYYTQMGRCMYTGEIIDIERLYDKELYDLDHIIPRKMKKDDSIHKNLVLVTRNSNQYEKKDNYPVPEVIKSRENVRHLWYALKKKGLITEEKYNRLTRINPLSDKELSEFIERQLVETRQTTKVVKDLFENYYTDSKIVTVKAGLVSELRRDFEVLKCREINDLNHAHDAFLNIIVGDVWSKKFTSNPYNFVKKNREKYTLNNIFTKNQKDLRGNEIWNCAEGKKRIIKTLNKPSVLFSVENFEQTGQLFDQNIIGKQDYKEKTSYVPIKGDERLQDISKYGGYRGISGAYFFIVEHTEKNKRVKTIESLPIYMKSYVEENGLLDFCTNEMKLVDPKIIVKKLNYKSEIIVDGFKYLISGKTENRLSLETNEYLYWNHTQTTDIKKILNINEKIELEKYNGDIESERENIIKYIQIILEKFKLKPFIKRRNLPNIEINFADYETEKLLQLLVNLIPLTTKYVSPVDLTVISGSKYAGKVLIPKKISNLNEVIFISKSITGIYESRRRII

SEQ ID NO: 253 - protein, 1007 aa, Helicobacter canadensis
  Helicobacter canadensis MIT 98-5491
MKVLGFDIGINSIGWAFVENNELKDCGVRLFTKAENPKTKESLALPRRNARSSRVRLRRRRSRLLSLKHIISKEFGLHYEDYIALDGNLPKAYTGKIESIYKLRYEALSQAISKEDLARVILHIAKHRGYMNKNQKTSQDSEKGAILSAIKENSNKIKHYQTAGEYFYKELFENLRDGTKEFKNIRNKAMKNEKTGNMESTYYNTILASDLEKELKLILEKQQAYHNYSDTFIKEVLEIAFYQRPLKDFSHLVGSCTFYENEKRACKNSYSAWEFIALGKIINTLESIKKDTGEIFSNEIITQILKEVLDKGSLSYTKLRKMINLDEKVKFKGLKYDKEGVEKTNLIEFKKLKEFKKALGEHNLERKTLDEIATHITLTKDENQLKKQLEQYALSQNQIDALAELDFNDHINLSFKALYEILPLMEKGKRYDEACNELGLKAKTSNQKSEFLPAFCDSIFAQELTNPIVNRAISEYRKVLNRLLKKYGKMHKIHIELARDAGLSKEARNKIEKEQKENKDINDKAEKTCKEFGLKPNAKNILKIKLWREQGEICAYSGKKITIDDLKEDKALEVDHIYPYSRSYDDSYNNKVLVFIKENQLKLNQTPYEAFGSNQEKWSKIQVLAQKLPYKKKNRILDENFKNKDQIEFISRNLNDTRYATSLIAKYTKEYLEFLPLSDDEDISLKSGEKGSKTHVQTMNGMLTSVLRHAWGFSQKDRNNHLHHALDAIIIAYSTNSIIKAFSDFKKNQEILKAKLYAKKLTSEEYKNQSKFTGFEKYRSKILEKLDSIFVSKPPNKNTKGALHEQTFYSYQDILEEYKTQEGLKRALECGKVRKIGTKYVVNDRMVRLDIFKKDNKFYGIPIYTMDFALGVLPNKVVTIGTDKDKIKKEWKTIDETYEFCFSLYKGDLVLIQKKEMQESEFAYYNGFDISSASISLEKHDNKFENLTENQKLLFPKAKEGDVEVRGIGIQGLKVFKKYMVTPLGEIQETRTEARQNIQPRKKHGLR

SEQ ID NO: 254 - protein, 1023 aa, Helicobacter cinaedi
  Helicobacter cinaedi CCUG 18818 = ATCC BAA-847
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFESKLLTKIFEQRPLKSFADKVGNCCFIAGEKRAPKDSPSAIEFIALSRTINTLINLSKESGEIYNRAIILQIVESTLKKGEISYKELREIIRLDERLRFKDPRLDYSREIKEAEKVKFLEFKQLKGFKKALGESFTTLAISQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNVLLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLSKGQKGSKKHIAIVNGVLTSTMRYYLGFASKDRDNHLHHALDAVIIGFMNDSVIKAFSDFKKTQETSKAAYYAHTLSKQEYKKQRAFIQLPSGENFRVSVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDQNGVIKDWLEMDSSYEFIFSLYKDDVILVQKKEMQRPELCYFVSFDTSGASIKVAKHDNNFSTLTENQKLLFSNATKEEVVGKSIGIQNLKVFEKWQVSVLGEVKRTQSYPRENISLASKAKK

SEQ ID NO: 255 - protein, 1023 aa, Helicobacter cinaedi
  Helicobacter cinaedi CCUG 18818
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFENKLLTKIFEQRPLKSFADKVGNCCFIAGEKRAPKDSPSAIEFIALSRTINTLINLSKESGEIYNRAIILQIVESTLKKGEISYKELREIIRLDERLRFKDPRLDYSREIKEAEKVKFLEFKQLKGFKKALGESFTTLAISQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNVLLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLSKGQKGSKKHIAIVNGVLTSTMRYYLGFASKDRDNHLHHALDAVIIGFMNDSVIKAFSDFKKTQETSKAAYYAHTLSKQEYKKQRAFIQLPSGENFRVSVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDQNGVIKDWLEMDSSYEFIFSLYKDDVILVQKKEMQRPELCYFVSFDTSGASIKVAKHDNNFSTLTENQKLLFSNATKEEVVGKSIGIQNLKVFEKWQVSVLGEVKRTQSYPRENISLASKAKK

SEQ ID NO: 256 - protein, 1023 aa, Helicobacter cinaedi
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFENKLLTKIFEQRPLKSFADKVGNCCFIAGEKRTPKDSLSAIEFIALSRTINTLINLSKESGEIYNRAIILQIVESTLKKGEISYKELREIIRLDERLRFKDPRLDYSREIKEAEKVKFLEFKQLKGFKKALGESFTTLARSQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNALLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLGKGQKGSKKHIAIVNGALTSTMRYYLGFASKDRDNHLHHALDAVIIGFMNDSVIKAFSDFKKTQETSKAAYYAHTLSKQEYKKQRAFIQLPSGENFRASVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDKNGVIKDWLEMDSSYEFIFSLYKDDLLLVQKKEMAEPELCYFMSFNSSIAQISVAKHDNNFSTLTKNQKLLFSNATQEDVSGKSIGIQNLQVFEKWQVSVLGEVKRTQSYPRENISLASKAKK

SEQ ID NO: 257 - protein, 1024 aa, Helicobacter mustelae
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 258 - protein, 1688 aa, Ignavibacterium album
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 259 - protein, 1092 aa, Ilyobacter polytropus
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 260 - protein, 1354 aa, Indibacter alkaliphilus
  Indibacter alkaliphilus LW1
MKKILGLDLGTTSIGWAFIKEPEKDVVGSEIVDMGVRIVPLSSDEENDFAKGNTISINADRTLKRGARRNLQRFKQRRNALLETFKEKNLIPSNFQYAEDGPSSTFSTLKLRDKAAKEKIELDDFVKVLLQINKKRGYKSSRKAMSEEDEGTAIDSMGIAKELYENDLTPGQWVYEALKNGRKNVPDFYRSDLQEEFKKIVNYQSEFYPDILNTSFVEDWMGKASTPTKQYFNKRGVQLAENKGKREERRLQEYKWRAEAVNFKIDLSEIALILSQINSQISNSSGYLGAISDRSKELYFKNLTVGQYLYQQVKKNPHTRLKGQVFYRQDYLDEFEKIWSVQSSFYPQLNDELKQEVRDVTIFFQRRLKSQKHLISNCEFEEHHKVVPKSHPIFQEFRIWQNLNNLTLIKKDNLNEKCELALEDKTALANELAFKKELSVKDALKVLGLKPSDWEFNFTKIEGNRTNHAFFEAFAKIIELEDGEPIDLGNLKADDILDQFSEAFLRIGIDTELLQVNSDIEGAEYEKQSYIQFWHLLYSSEDDQKLKQNLIRKFGFKPEHAKILASISLQDDHASLSSRAIKKILPHLQSGLIYDKACTYAGYNHSSSFTKDENEKRELRAELELLKKNSLRNPVVEKILNQMINVVNAILKDPNLGRPDEIRVEMARELKANAEQRKNMTSNIASATRDHEKYREILKKEFGLKRVTKNDLLRYKLWLETDGISLYTGKPIEASKLFSKEYDIEHIIPKARLFDDSFSNKTICERQLNIDKANVTAFSFLQNKLSADEFEQYQSRVKSLYGKLSKAKIQKLLMANDKIPEDFIARQLQETRYISKKAKEILFEITMRVSVTTGTITDKLREDWGLVEIMKELNWEKYDKLGLTYTIEGKHGERLNKIKDWNKRNDHRHHAMDALTVALTKPAYIQYLNNLNAKAIGNKKGTEIFAIEQKYLKRENGKLCFIPPIENIRAEAKKHLSKILVSYKAKNKVVTINKNKTKKKAGFNEQTALTPRGQLHKETVYGKSFHYSTKFEKIGASFDAQKINTVAKKEEREALLKRLAENGNDPKKAFTGKNSLNKMPIYLDLGKNIKLSEKVKTVVLEQNYTIRKNIDPDLKVDKVIDVGIKRILESRLEEFGGNAKLAFSNLEENPIWLNKEKGIPIKRVKISGVSNVESLHVKKDHFGEKILDEEGNEIPVDFVSTGNNHHVAIYEDEDGNLQDEVVNFYEAVIRRNQGESIIKYRHEEGWNFLYSIKQNEFFVFPSQDFNPNDFDLLDPKNYDLISPNLYRAQKFSKVMYGNSAVRDYVFRHHLETVLNDVKELKDVAYKQLKSLQYLNGIKKVRLNHLGQIIQVGEY

SEQ ID NO: 261 - protein, 1397 aa, Joostella marina
  Joostella marina DSM 19592
MKKVLGLDLGTNSIGWALVNEATKEEKKEGKSSEIIKLGVRVNPLTVDEKTNFEKGRPLSTNADRTLKRSARRNLQRYKLRRRNLIEILIKNGFITKDTPLTETGKDTTHQTLKLRAKSAKEKVDLKDFAKILLTINKKRGYKSSRKVNSDEDGLAIDGMAVAKHLYEQNLTPGQYVLNLLQKNKKYVPDFYRSDLQEEFKNIWNNQKTYYFDILTDTLFEELKDKNKSQTWAICKKPFDIAGIKQIGKASDKRLERYKWRTEGLTQKLNLEYLAIALQEINNDINKSSGYLGAISDRSKELFFNKETVGENLYRQLVKTPHTSLRNQVFYRQDYLDEFETIWETQAKFYPQLTHTLKEEIRDVIIFYQRKLKSQKSLISFCQFESWEQTYIEKETGKSKTRTVGRKVIPKSSPLFQEFKIWQNLNSLEFRNSDEGEIIEFIKLDEDIRQTVFEELNLRGNLKPNDVLKILGNYISLGKVSQWKCNFEEIEGNRTNAALYNVYQIIAENEGYGFDWAKKTASEINKELKNIFPQLGIDASILDFDFTQANFDKQTSYQLWHLLYSAEEDFKISEEDKVLYGNSSVSLKKKLHQKYGFKPEYTKLLTNISLQPDYGNLSAKAICNILPYLKENNVYSEACDLTGYNHSNFLTAEEQAKRPLKPILELLKKNSLRNPVVEKILNQMVNVVNQVIETYGKPDEIRIELTRELKKSAKERANMTKSIADATRRNDDYRKTIIKEFGIPNPTKSDVVRYRLWQELASRGYKDIFTDTEIKPQELFSNKIDIEHIIPKALLFDDSFSNKTLAFKKDNLKKANRTAYDFIANDYAPNLENYIERVESLHKDRKITRAKRNKLLMLQSKLPDGFIERDLRNSQYITKEAKKMLYEVCRTVVSTSGSITDKLREDWDLINVMKELNFPKYKALGLTEKIERYDIGAEKMKEVEIIEDWNKRNDHRHHAIDALTVAFSTHSHIQYLNHLNARRDEGHKKHAAIIAIESTITEKEGNKKRRFIAPLPNFRLQAKEHIESILVSFKNKNKVVTNNINKTKRIKKDKFNTKVQLTPRGQLHKETIYGKIKQPLEKHIKLNKSFTLEQAKLIIDKRQREKVLNHLEKYAHNSDIAFNSKTLKKNPLLISDEPLKEVLCFEEVFTIRKDISYDNFKNEKQLDKVIDEKVKQALKERINQYNGDFREAFSDIERNPIWLNKAKGICVKRATIKGVSNAEPLHTAKNHLGEEVLTENKEQIPVDYVSTGNNHHVAIYEDEDGNLQEKVVSFYEAVIRVNEGLPIIDKEYNKSLGWTFKFTMKQNEMFVFPSEDFNPTEIDLLDQKNASLISPNLFRVQKFTIKDYFFRHHLETTVENNNTLKNTTWRREGLSGIYGIIKIRLNHLGEIVQVGEY

SEQ ID NO: 262 - protein, 1060 aa, Kingella kingae
  Kingella kingae PYKK081
MAAKSLNYILGLDLGIASCGWAVVEMDEQENPLRLIDVGVRTFEEAENPKDGSSLAETRRLARAQRRLISRRANRMNKLCRLLKQENVLQANDYDEKGLIIGLPNQAWELRAQGLDRKLEPKEWAAVLIHLVKHRGYLSQRKNESQTADKELGALLSGMNHNHQLLQSQSNQYRTPAELAIKQFATQDGHIRNQRGAYTHTFNRLDLQNELNQLFDAQTRLGNPHVSGSLKTAINDLLMNQKAALSGDAILEMLGRCTFEPSEYKAAKNTYSAERFVWLGKLTNLRIQDNGLESALSREQRELLLNEPYNKTKLTYQQVRKLLRLPETAFFKGLRYGKDNAESATFMEMKSYHAIRKSLENKSLKSEWEKLKTQPKLLDLIGTAFSIYKTDDEIAGCLKNQLPENVIIALQGQLNFSNFMELSLKALEKLLPLMEQGLRYDEACTQIYGNRHEKIADKTEKFLPNIPADKLRNPVVLRTLTQARKVINAIIRRYGSPARVHIETGREVGKSFSDRDKLKKQQEENQEQRRRAIDEWKQFFPNAAHEPKAVDILKLRLYQLQQGKCLYSGLPIDVRRLPEKGYVEIDHALPFSRTWDDSFNNKILVLASENQNKGNQTPYEYLRGADNSESWRLFVENVQNCQFSPNKKQKIMAKQLDEKGFLERNLNDTRYVSRFLCQFISEHLHLTGKGKKRVFASNGQITALLRGRWGLSKNREENDRHHAVDAVVVACSTVAMQQKITQFVRYQKGNVFTGERIDKETGEVISIHFPTPWEHFREEVMIRVFDDNPLRTLPEKLPNRPEALHEYVMPLFVSRMPTRKMTGQGHKETIKSAKRLDEKISVLRVPLTQLKLNDLENMVNREREPALYEALKARLEQFKNDPAKAFAEPFFKQGGQQVKAVRVEIVQKSGMLLRKINGVADNGSMVRVDVFEKSGKFYLVPIYAWQVAEGILPNYAVVAHKDESDWILMDESYHFKFALYKNDLLEVQTKKGGIMGYFASLDRATGAITIREHDRDKKKCKDGEHRSIGVKMASSFKKLQVDELGKNIHETRSRKRPNIG

SEQ ID NO: 263 - protein, 1391 aa, Kordia algicida
  Kordia algicida OT-1
MKKILGLDLGTNSIGWALVNEAEHEHEQSSIVKLGVRVNPLSVDEKTNFEKGRPLSINADRTSKRSARRNLQRFKLRRKNLINLLLKHHIISNETILTEVGKNTTHQTLKLRSKATQEKISLEEFARILLSINKKRGYKSSRKEKNEDEGFTIDGMAIAKELYDNQLTPGQYVYNILQDGKNYIPDFYRSDLQAEFDDVWQFQKKFYSSILTDEFYLKLKGQGKENTRKLFLAIHQVYTAENKGKRDAVKLQYYKWRSEAVKKQLSIEEVAYVLVEINNNINKSSGYLGAISDRSKALYFNNETVGEYLYGQLVKNRHNSLRNQVFYRQDYLDEFEKIWETQAKFYDELTNELKQEIRDVVIFYQRKLKSQKHLISDCLFEKHHKAIPKSSPLFQEFKIWQNLNYLEFVHTQSKEKIFFSELDDETRQFVFAELNIRGTLKIKEIKKLIGLETPVYWKSNFDEIEGNRTNQVLYNVYQNIADDLGYGFDWSKKHAFEINAELQAIFKDVGIDTAILNFDASIEENDFDKQKSYQLWHLLYSAEDTDKATEEDKLIYGNINTKLKKQLHQKYGFEAKYGNLLANISLQQDYGNLSAKAIKKILPYLESGNSFYEACTIVGYNPSNSLTKEQQQNRKLKDKLELLPKNSLRNPVVEKILNQKVNLINQLIDEYGKPDEVRIELARELKKSAKQRADLSKHINDATLKNQNIRKTLQKDFGIQNPSKNDVIRYKLYDELKDNGYKTLFTNKYIPKEQLFSKDVDIEHIIPKAILFDDSFSNKTLAYRNVNLAKADATAFDFISSKHLDDLDNYKARVETLFQSKRISKGKYKKLLMTRQNLPEDFIERDLRNSQYIAKKATAMLKEVFRSVVPTSGRITDKLREDWDLVNVMKELNLPKYRTLGLTEFIERKNGNKIEQIIDWTKRNDHRHHAMDALTVAFTTHNHIQYLNNLNVTHGLNGVDTDHEKSRLYAIKQAITKVYIVGKTKKRKFIPPMENFRSHAKNHLEGILISFKNKNKVVTKNKNRTKTKTKGVFNEKIQLTPRGQLHKETIYGHAKKVIVTKEKVSSKFTHEKILQVTKPAYREALLKRLASFKNDPKKAFSGKNALSKNPLYFDITSGKKVPDTVKLSYFENSYVIRKEVNSDNFKNEKSLQKVLDVGIRRILEKRLADYNGNAKEAFSNLEKNPIWKDKEKGVCIKKVRIEALKNAEPLHVKKDHLGKIILDDENKSTPVDFISTGNNHHVAIYEDKDGKLHDKVVSFYEVVSRVNLGLPIIDKSFNSHLDWKFLFSMKQNEMFVFPSEDFNPKEIDIGNPKNNELISKYLFRVQKFSKVTYGNSAVRDYVFRHHLETELIDKKELKGITYYQLKSIGMLEKLVKVRINHIGKIVHIGEY

SEQ ID NO: 264 - protein, 1314 aa, Lactobacillus animalis
  Lactobacillus animalis KCTC 3501
MLKKDYSIGLDIGTNSVGHAVVTDDYKVPTKKMKVFGDTSKKTIKKNMLGVLLFNEGQTAADTRLKRGTRRRYTRRKNRLRYLQEIFAPELAKVDPNFLYRLEESSLVAEDKKYDVYPIFGKREEELLYHDTYKTIYHLRSALANNDQPADLRLVYLALAHIIKYRGNFLLEGEIDLRTTDINKVFAEFSETLNENSDENLGKLDVADIFKNNTFSKTKKSEELLKLSGAKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKHMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMTEDYSQNFMQLINDDNYSFKETIKNAQVIEKEETLAKTVQELPGSPAIKKGILQSLEIVDEIIKVMGYKPKSIVVEMARETQKTHGTRKREDRVQQIVENLKDANELPEKLPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAIVANLIMAKYPELEPEFVYGKYRKAKFKGLGKATAKNTLYANVLYFLKENEVYPFWDKARDLPTIKRYLYRAQVNKVRKAERQIGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASFKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 265 - protein, 1377 aa, Lactobacillus brevis
  Lactobacillus brevis subsp. gravesensis ATCC 27305
MESNHDGEQVKYTLGLDIGTSSIGYAAIDKHQKPIRAKGKHVIGVRLFQEGQTAADRRAFRTTRRRLKRRKWRLNLLNRLFDPYLSEVDPNFLPRLRQSNLSPKDDNKHFNGSTLFPDKTDAAFYRQYPTMYHLRYALMTEKRKFDIREVYLAIHHIVKYRGNFLNSATVDSFKTSNIDFTSQFDRLNELYRQVILDEPFQINMDQVDEMTNKLLDNDALKLDTQKQVAKLLPVIYNDKPIDKQYTRIATEFSKAILGYKTKLDVILNLDTQNAKDWVIRLDDEDIDDKLPALVENLDESRQEIVTIIRDLYAQITLNAIVPKGKSLSESMVDKYNDHKDHLDLLMGLIHELGDDSAKGIKLREAYTQYVGKSDDKTLNQDDFYAAIKKNLDEDSKRSPKIQRLIEQASFMPKQRTSANGVIPHQLHQLELDRIIENQGRYYPFLKKPNPNTHKPNGGKYKLDELVAFRIPYYVGPLITKRDQEKTSGADFAWMIRKPGQEGEITPWNFDQKVDRMASANRFIRRMTTKDSYLVAEDVLPDASLIYEKFKALNELNMLKVNDSRLSPSQKQDLFNNLFKKQKTIRTKKLQTYIRTNWELPSVMISGLADPDKFNSSLSTYIDFRDIFGEKVDDPNRQADYEEIIEWSTVFEDRKIYQAKLNQLDWLTEPQRKALLTKRYTGWGRLSKKLLTGLKDQNGDSILDQLWKTNDNFMQIQSRDEFAKQIHDENAKQFHEANNVDDILDDAFTSPQNKKAIRQVDKVVQDVVKAVGYAPDKIAIEFTRSLENNPQRTVSRQRQLQAAYKNIPREIMKSGLMAELGSVADSKKVLSDKLYLYFTQMGKDMYEDKTINIDNLPNYDIDHILPQAFIKDDSIDNRVLISKEENARKSNRVPLKFFGAKRMGFWKDLLNNGLISNRKFQNLTTDPEKISKYSAKGFIHRQLVETSQVIRLVANILGNEYSQAGTTIIEVSAKMNRQLREDFHLIKNRNVNDYHHAMDAYLTAYVGDYLYLRYPKLRPYFVYGDFKKAEDQDLNIRNFNFLHDLKDNESLDKIVDSETGEIVWEKHGSVKQLKKVYHYKFMLVSQEVYTRQDALFNQTIYPASDADKRKLIPIKNSKPVDVYGGYSGNIDAYMAIVRVHGKKEDNYKVVGIPMRAVTKLKKAEKEGHDSYLNAVHEVLKPQFTKKKKNRKTGEITETVDEFDVLLGKVYYRQLIVDGNKKFMLGSSSYQYNAKQLVLSDKAMQVLSKNGKVKSQDENQNLIDVYDEILEKVDQYFELYDQRHYRESLHKGRGIFVNLPLSNQYDGSKLTSYGKYETIDAILNGLHANATMSNLRYLGISSPFGKMQASNGLTIDPDSIICYQSPTGLFERQIKLSDL

SEQ ID NO: 266 - protein, 1371 aa, Lactobacillus buchneri
MKVNNYHIGLDIGTSSIGWVAIGKDGKPLRVKGKTAIGARLFQEGNPAADRRMFRTTRRRLSRRKWRLKLLEEIFDPYITPVDSTFFARLKQSNLSPKDSRKEFKGSMLFPDLTDMQYHKNYPTIYHLRHALMTQDKKFDIRMVYLAIHHIVKYRGNFLNSTPVDSFKASKVDFVDQFKKLNELYAAINPEESFKINLANSEDIGHQFLDPSIRKFDKKKQIPKIVPVMMNDKVTDRLNGKIASEIIHAILGYKAKLDVVLQCTPVDSKPWALKFDDEDIDAKLEKILPEMDENQQSIVAILQNLYSQVTLNQIVPNGMSLSESMIEKYNDHHDHLKLYKKLIDQLADPKKKAVLKKAYSQYVGDDGKVIEQAEFWSSVKKNLDDSELSKQIMDLIDAEKFMPKQRTSQNGVIPHQLHQRELDEIIEHQSKYYPWLVEINPNKHDLHLAKYKIEQLVAFRVPYYVGPMITPKDQAESAETVFSWMERKGTETGQITPWNFDEKVDRKASANRFIKRMTTKDTYLIGEDVLPDESLLYEKFKVLNELNMVRVNGKLLKVADKQAIFQDLFENYKHVSVKKLQNYIKAKTGLPSDPEISGLSDPEHFNNSLGTYNDFKKLFGSKVDEPDLQDDFEKIVEWSTVFEDKKILREKLNEITWLSDQQKDVLESSRYQGWGRLSKKLLTGIVNDQGERIIDKLWNTNKNFMQIQSDDDFAKRIHEANADQMQAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGEPINIDELNKYDIDHILPQAFIKDNSLDNRVLVLTAVNNGKSDNVPLRMFGAKMGHFWKQLAEAGLISKRKLKNLQTDPDTISKYAMHGFIRRQLVETSQVIKLVANILGDKYRNDDTKIIEITARMNHQMRDEFGFIKNREINDYHHAFDAYLTAFLGRYLYHRYIKLRPYFVYGDFKKFREDKVTMRNFNFLHDLTDDTQEKIADAETGEVIWDRENSIQQLKDVYHYKFMLISHEVYTLRGAMFNQTVYPASDAGKRKLIPVKADRPVNVYGGYSGSADAYMAIVRIHNKKGDKYRVVGVPMRALDRLDAAKNVSDADFDRALKDVLAPQLTKTKKSRKTGEITQVIEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVLDGNTKVSSGKREILQEILNGLHANPTFGNLKDVGITTPFGQLQQPNGILLSDETKIRYQSPTGLFERTVSLKDL

SEQ ID NO: 267 - protein, 1371 aa, Lactobacillus buchneri
MKVNNYHIGLDIGTSSIGWVAIGEDGKPLRIKGKTAIGARLFQEGNPAADRRMFRTTRRRLSRRKWRLKLLEEIFDPYITPVDSTFFARLKQSNLSPKDSRKEFKGSMLFPDLTDMQYHKDYPTIYHLRHALMTQDEKFDIRMVYLAIHHIVKYRGNFLNSTPVDSFKASKVNFVDQFKKLNELYTAINPEESFQINLANSEDIGHQFLDPSIRKFDKKKQIPKIVPVSVDDKATDKINGKIASEIINAILGYKSKLDVVVQCTPVDSKSWALKFDEEDIDAKLQKILPEMDENQQSIIAILQNLYSQVTLNQIVPNGMSLSESMIEKYNDHHDHLKLYKKIIDQLADPKKKAALKKAYSQYVGDDGKVIEQADFWSSVKKNLDDSDLSKQIMDLIDAEKFMPKQRTSQNGVIPHQLHQRELDEIIEHQSKYYPWLAEINPNKHDLHLAKYKIEELVAFRVPYYVGPMITPDDQAKSAETVFSWMERKGKEAGQITPWNFDEKVDRNASANRFIKRMTTKDTYLIGEDVLPDESLLYEKFKVLNELNMVRVNGKLLKVADKQAIFQDLFENYKHISVKKLQNYIKSKTGLPSDPEISGLSDPEYFNNSLGTYNDFKKLFGNKVDEPDLQDDFEKIVEWSTVFEDKRILREKLNEITWLSDQQKDVLESSRYQGWGRLSKKLLTGIVNDQGERIIDELWNTNKNFMQIQSDNDFAKRIHEANADQMKAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGKPINIDEISTYDIDHILPQAFVKDDSLNNRVLVSKAINNGKSDNVPVQLFGAKMGHFWKQLAEAGLISKRKLKNLQTDPDTISKYAMHGFIRRQLVETSQVIKLVANILGDKYRNDNTKIIEITARMNHQMRDEFGFIKNREINDYHHAFDAYLTAFLGRYLYHRYIKLRPYFVYGDFKKFKEDKVTMRNFNFLHDLTDDTQEKIADAETGEVIWDRENSIQQLKDVYHYKFMLISHEVYTLRGAMFNQTVYPASDAGKRKLIPIKADRPINVYGGYSGSADAYMAIVRIHNKKGDKYRVVGVPMRARDRLDAAKKVSDADCDRALKDVLTPQLTKTKKSRKTGEITQVVEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVFDGNTKASSGKREILEEVLNGLHANPTFGNLKDIGITTPFGQLQQPNGILLSDEAKIRYQSPTGLFERTVSLKDL

SEQ ID NO: 268 - protein, 1361 aa, Lactobacillus casei
  Lactobacillus casei BL23
MTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 269 - protein, 1361 aa, Lactobacillus casei
  Lactobacillus casei Lc-10
MTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGNTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 270 - protein, 1363 aa, Lactobacillus casei
  Lactobacillus casei M36
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLDEKATPSDTQRALVNLLLAEDGDKDILKQQKQVLTEFAKAVVGLKMKLNVALGTEVDSSEATAWNFSLGQLDDKWAGIESAMTDEGTEILDQIRDLYRARLLNGIVPAGKTLSQAKVDDYEQHHEDLELFKDYLKQLEDDGMAKVIRQLYDRYIDGDDAKPFVREDFVKALTKEVTAHPNAKSPELLERLVQPDFMLKQRNKANGAIPVQMQQRELDQIIKNQSVYYDWLAAPNPVEKHRQSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDIEKIIAWSTIFEDKAIFKTKLNEISWLTAGMINSLANIRYRGWGQFSHKLLNELTLSTGRTVFEELLISSHNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDAKIIAVKAGLSSQLRKELDFPKNREVNHYHHAFDAFLAARIGTYLLKRYPNLEPFFTYGKFKKTEVKKLKSLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 271 - protein, 1361 aa, Lactobacillus casei; identical to SEQ ID NO: 268
  Lactobacillus casei group

SEQ ID NO: 272 - protein, 1360 aa, Lactobacillus casei
  Lactobacillus casei T71499
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTPGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDADKQTDIENIIAWSTIFEDKAIFKTKLNEISWLNAGMINSLANIRYRGWGQFSHKLLNELTLSTGRTVFEELLISSRNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 273 - protein, 1366 aa, Lactobacillus casei
  Lactobacillus casei UCD174
MTKLGKPYGIGVDIGSNSIGFAAVDENSHLIRLKGKTVIGARLFEEGKAAAYRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTPGYAKDFNTNKVALNEIFPALQDAYAQVYPDLDITFDENKVNEFKTVLLNEKATPSDTQRALVNLLLAKEGDRDILKQQKQVLTEFAKAVVGLKTKLNVALGTEVDSSEATAWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQAVYYDWLAAPNPVEKHRQSMTYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDADKQTDIENIIAWSTIFEDKAIFKTKLNEISWLNAGMINSLANIRYRGWGQFSHKLLNELTLSTGRTVFEELLISSRNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGEFEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSLKSLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQIEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 274 - protein, 1389 aa, Lactobacillus casei
MIIRTYELKTITTIAILKMFQLLTGGLSMTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 275 - protein, 1354 aa, Lactobacillus coryniformis
  Lactobacillus coryniformis subsp. coryniformis KCTC 3167
MTLHYNVGLDIGTNSVGYTIVDDNGKILQVKGKNGYGVRVFKEGATAAERRIFRTTHRRLKRRKWRLRLLQDFFEPYILPQDDGFFIRRKESNLVLNDRDEDTASLFNDRSDRDFYQAYPTIYHLRQALMTEKRQFDVREIYLAMHHIIKYRGHFLLNGTVNNFTNNKIDLHSDFEELNALLLNVIPELKFQIDLDHSTMFQTTLLNTTISRSGRQRDLVKSFYNGSDDKQLAKQQKSVATELLKAILGLKAKFHKLFNLDLLETTEWEFSFDAEDIDDKLAKLEPLMTENQQQVMDILQRIFAAITLNGIVPEGKTLSASKVDSYQKHKQDLKLLKAIAQHSDKKTATVLQTAYNEYINGIASKPLKQEDFYKRLTNAVKKSSDPQVADMLALIDQEKFLPKQRTKENGAIPHQLHQLELERIIDNQKDYYPWLAELNPNQARQKVAKYKLSELVAFRVPYYVGPLIEPEVQQATSNAHFAWMARKEAGPITPWNFDQKVDRNVSAERFIKRMTTKDTYLLAEDVLPLHSLLYQRFIVLNELNNVRVNGQKLTKKQKQAVYQDLFKRQPHVTKKQFKSYLVQTGEFAESSKIEGLANETSFNSGLTTENELRKIFGAQLDEARYQVDFEQIIEWATLFEDAKILRTKLAEITWLTTEQIEKLAGIRYRGWGRFSRKLLAGLRDQNGQQIIDLLWDTPNNFMVIVSQAAFSEAITKENEKLIDRRGAQDVITDLYTSPQNKKALRQVLAIVADVQKAMGGVPPQRIFIEFAREDEKNPRRSVERSRQLEKLYQTISNEFLINSEVRQELKEAVDQKVNFKDRLFLYFLQGGVDLYSGKRINIDQLSHYDIDHILPQSFIKDDSLDNRVLVSQKLNRSKSDSVPLSEFANYKFGPAMQAKWLQLKEAGLLSKRKYDNLTLDPTKLSKFAPLGFVNRQLVETRQVIKLAANLLASEETKVVTIKANMTHQVRKELDFPKNRNVNNYHHAFDAYLTAFVGIFLSKRYPKLKPYFTYGDFQKGNKLPDLKNFNFLYELKNKDRSIDSNTGEIIWDKQRDLAYMNKIYNFKKVTVVHEVLTKSGALYNQTLYKASEDKASGRGTKQLIRKKDNMPTELYGGYTGSTSAFMSIVRLWKKDKPYYKVVGIPTRMAAKLANQAQLLDYLTKKFTTRKLVKKTGDYKTTVERFELVVPKVGFNQLVIDGGQPFMLGSATYQYNARELFISKEAVKALNKQLSTHVDLVQVFDEILVQVNRWFPLYDTNGFREKLSHGRDRFMKLNDSFEEKSDTQIDVLNRILIGFHANAARTNLKILGLGTDLGFMTQQAGIRLTEKAILVHQSPSGLFERKVALRDLKGLR

SEQ ID NO: 276 - protein, 1119 aa, Lactobacillus coryniformis
  Lactobacillus coryniformis subsp. torquens KCTC 3535
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 277 - protein, 1368 aa, Lactobacillus curvatus
  Lactobacillus curvatus CRL 705
MSRPYNIGLDIGTSSIGWSVVDDQSKLVSVRGKYGYGVRLYDEGQTAAERRSFRTTRRRLKRRKWRLGLLREIFEPYITPIDDTFFLRQKQSNLSPKDQRKLYTQTSLFNDRTDRAFYDDYPTIYHLRYRLMTEKRQFDIREIYLAMHHIVKYRGHFLNEAPVSSFKSSEINLVAHFDRLNTIFADLFSESGFQLETDKLAEVKALLLDNQQSASNRQRQALSLIYTPSTNKAVEKQNKAIATELLKAILGLKAKFNVLTGIEAEDVKAWTLTFNAENFDEEMVKLESSLDDNAHQIIESLQELYSGVLLAGIVPENQSLSQAMITKYDDHQKHLKMLKAVREALAPGDRQRLKQAYDQYVDGQENTKAYSKEDFYGDITKALKNNPDHPIVSEIKKLIELDQFMPKQRTKDNGAIPHQLHQQELDRIIENQQQYYPWLAELNPNSKRQTVAKYKLDELVAFRVPYYVGPLITAEQQRQSSDAKFAWLIRKAEGRITPWNFDDKVDRQASANEFIKRMTTTDTYLLAEDVLPKQSLIYQRFEVLNELNGLKIDDQPITTELKQAIFTDLFMQKISVTVKNIQDYLVSEKRYASRPAITGLSDENKFNSRLSTYHDLKMIVGDAVDDVDKQADLEKCIEWSTIFEDGKIYSAKLNEIDWLTDQQRVQLAAKRYRGWGRLSAKLLTQIVNANGQRIMDLLWDTTDNFMRIVHSEDFDKLITEANQMMLAENDVQDVINDLYTSPQNKKALRQILLVVNDIQKAMKGQAPERILIEFAREDEVNSRLSVQRKRQVEQVYQNISNELLNNTEIRNELKDLSNSALSNTRLFLYFMQGGRDMYTGDSLNIDRLSTYDIDHILPQSFIKDNSLDNRVLVSQKMNRSKADQVPTDFTSVELGQKMQIQWEQMLRAGLITKKKYDNLTLNPDHISKYAMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKWRNFNFLNGLKKDELVDENTEAVIWDKESGLAYLNKIYQFKKILVTRGVHENSGALFNQTLYAAKDDKASGQGGKQLIPAKQDRSTALYGGYSGKTVAYMCIVRIKNKKGDLYKVCGVETSWLAQLKQLTDEDSQKAFLEQKISPQFTKVKKQKGNIIEAVEEFEVIAPHILINQRFFDNGQELTLGSATYKHNEQELILDKTAVKLLNGALPLTQSEELAEQVYDEILDQVMHYFPLYDTNQFRAKLSTGKAAFMKLPWKSQWDGNKMVQVGQQVILDRILIGLHANAAMSDLKVLKMTTPFGMIQQSTGITLSADTQIIYQSPTGLFERRVALRDL

SEQ ID NO: 278 - protein, 1126 aa, Lactobacillus farciminis
  Lactobacillus farciminis KCTC 3681
MADRISLGLDIGVASVGFSVLDIDKGKVIELGARLFSATVAAGNQDRRDMRGARRLLNRNKQRRQDTGKLFKKFGLIDDFDKGSFYDNFNQNLNPYELRVKGLTEQLTKEELAESLYQIVKHRGISYALKDADVDEGGTDYSVSLKINSQELAEKTPAQIQLQRLNDYGKVRGQVVIGDDPDNQKVLLNVFPTSAYEKEAKQIIATQQQFYPESLTDKFTEEYCQILTRKRDYFVGPGNEKSRTDYGIYKTDGRTLDNLFEELIGHDKIYPEELRASAASYTAQLFNVLNDLNNLRILNYEDGKLTKEDKEKIIAEIKNNTTTINMLNVIKKVAGCSKDDIKGFRVNEKDKPEISSMPVYRKIHKDLLKAGVDISDWPVEFIDELSFILTLNTENGEIRKQLNNRLAPKFDFLNADLIQLIIDNKDSFEIKTNNKWHRFSVKTMNKLIPEMMERPVEQMTLLNEMGLVKKDKKRFENNKYLPYKEIAKDIFNPVASKSVREALKIVNAVLKKYGHIDYLVVEMPRDKNLKEEQDNIKEFQNKNKKAKDAAFEAFVKSVGSEQRVKEALSKNRKLQMKMRLWYQQQEIDPYNGKTIDATDLINNPDKFEIDHIIPQSISFYDSINNKTLCFASMNQVKGQKTPYEFMLEGHGQSYDKFKATVMANKNFGKAKRANYLFEENVSDIETRKRFLSRNLVDTRYSSRVVLNSLQDFFREKSADTKVTVIRGKFTSNMRKHWHIDKTRETFHHHAIDASIIAATPFLRMWKKGGTIFPVKVGEESIDIETGEILDDKNFDKAMYEEPYSGFVSEIMNADDRIKFSHQVDKKMNRKVSDATIYSTRTGKLAKDKKDAEYIVAKVKDIYSVDGFKKFKKVYDKDKTKFLLYKYDPRTFSKLERIISDCPDKVEKVQTNGKVKAVDISPFEMYRRDHGMIKKYSKKGNGPAIKQLKYLDKKLGSHIDITPANANGKHVILQSLKPWRTDVYLNHETGEYEIMGIKYSDLKFNKNEGYGIKKDKYLEIKKVEEVSEKSEFMFSLYRKDRVKVQDMKTGESVELLFWSRNFSNKKYAELKPISQAENDKKLPVYGKGRLIKRLIPKNCKIWKVNTTILGDPYYLEKESDSPKDILD

SEQ ID NO: 279 - protein, 1356 aa, Lactobacillus farciminis
  Lactobacillus farciminis KCTC 3681
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 280 - protein, 1313 aa, Lactobacillus fermentum
  Lactobacillus fermentum 28-3-CHN
MHYLDEIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIMKYRGHFLNNASVDKFKVGRIDFYKSFNVLNEAYEELQNGEGSFTIEPSKVEKIGQLLLDTKMRKLNRQKAVAKLLEVKVADKEETKRNKQIATAMSKLVLGYKADFATVAMANGNEWKIDLSSETSEDEIEKFREELSDAQNDILTEITSLFSQIMLNEIVPNGMSISESMMDRYWTHERQLAEVKEYLATQPASARKEFDQVYNKYIGQAPKERGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKVSDVASLVMAKTRGVNKPSVEGLSDPKKFNSNLATYLDLKSIVGDKVDDNRYQTDLENIIEWRSVFEDGEIFADKLTEVEWLTDQQRSALVKKRYKGWGRLSKKLLTGIVDENGQRIIDLMWNTDQNFMQIVNQPVFKEQIDQLNQKAITNDGMTLREWVESVLDGAYTSPQNKKAIWQVVRVVEDIVKAVGNAPKSISIEFARNEGNKGEITRSRRTQLQKLFEDQAHELVKDTSLTEELEKAPDLSDRYYLYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKKRPVDLYGAYTNGTSAFMTIIKFTGNKPKYKVIGVPTTSAVGLKRVGKPGSESYNQELHRIIKSNPKVKKDFEIVVPHVSYSQLIVDDDCKFTLASDTYQHPATQLVLSKESMEIIADDFKFVKENTATADEQLVRVFDEIVNQMNHYFTIFDQRSNRQKVTKARDKFVSLPTESEYEGAKKTQVGKTEVITNLLMGLHANSAQGDLKVLGLSTFGFFQSSGGLNLSEDAMIVYQSPTGLFERRICLKDI

SEQ ID NO: 281 - protein, 1381 aa, Lactobacillus fermentum
  Lactobacillus fermentum ATCC 14931
MDYVKEYHIGLDIGTSSIGWAVTDSQFKLMRIKGKTAIGVRLFEEGKTAAERRTFRTTRRRLKRRKWRLHYLDKIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIVKYRGHFLNNASVDKFKVGRIDFDKSFNVLNEAYEELQNGEGSFTIEPSKVEKIGQLLLDTKMRKLDRQKAVAKLLEVKVADKEETKRNKQIATAMSKLVLGYKADFATVAMANGNEWKIDLSSETSEDEIEKFREELSDAQNDILTEITSLFSQIMLNAIVPNGMSISESMMDRYWTHERQLAEVKEYLATQPASARKEFDQVYNKYIGQVPKEKGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKAGDVASLVMAKTRGVNKPSVEGLSDPKKFNSNLATYLDLKSIMGDKVDDNRYQMDLENIIEWRSVFEDGEIFADKLTEVEWLTDEQRSALVKKRYKGWGRLSKKLLTGIVDENGQRIIDLMWNTDQNFMQIVNQPVFKEQIDQLNQKAITNDGMTLRERVESVLDDAYTSPQNKKAIWQVVRVVEDIVKAVGNAPKSISIEFARNEGNKGEITRSRRTQLQKLFEDQAHELVKDTSLTEELEKAPDLSDRYYFYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKNRPVDLYGAYTNGTSAFMTIIKFTGNKPKYKVIGVPTTSAVGLKRVGKPGSESYNQELHRIIKSNPKVKKDFEIVVPHVSYSQLIVDGDCKFTLASDTYQHPATQLVLSKESMEIIADDFKFVKENPATADEQLVRVFDEIVNQMNHYFTIFDQRSNRQKVTKARDKFVSLPTESEYEGAKKTQVGKTEVITNLLMGLHANAAQGDLKVLGLSTFGFFQSSGGLNLSEDAMIVYQSPTGLFERRICLKDI

SEQ ID NO: 282 - protein, 1327 aa, Lactobacillus florum
  Lactobacillus florum 2F
MTEQQQPYNIGLDIGTSSIGWAVTDQNDKLLHIRGHNGIGVRLFKEGESAAERRGFRTTRRRLSRRRWRLRFLDRIFDAELAKVDPNFLARLKQSNISPLDPNKQMFGNILFDDPQFDDQKFHQQYPTIYHLRSALAQPDAPQADVRLIYLALHHMIKFRGHFLNGAAVEKFHGGQLHLESEFQELNQIFSNQQRDHVQLQTSSLDEVATILKDNQRTPSDRQRELSARLFVPVDKTIDKENKKLATELLKAVLGLKAKFDVILGVEATDPQAFKLQFSSDDFDDKIAELASELTDEANEILTVLQRLYFSLNLADILTNRQTKQVADSISTAMINRYDDHKHHLKMLKELEAQVTQEQRDGLKKAYDEYIDGDKPTIDTFYTNIKKNLDDSELANQIKSLIDLQAFMPKQRSKENGSIPHQLHQRELDQLIEVQGKYYPWLLAAKDKLDALIAFRVPYYVGPMIDPNQSDDPQNTKFAWMVRKEAGEITPWNFEEKVDKTSSATNFIKRMTTTDTYLLGEPVLPKNSLLYQQFTVLNELNKLKVNGKALTVDQKKYLYEHVCKKQRRVTLKKLSDCLMARGDFPMGAIFTGTTDQKNMNNTLKTYQDFQEIFGDEIDNPDRQVDFEKMIEWSAIFEDREIFKLKLAELNWLTSEQLERVSKKRYQGWGRLSQKLLTHIVNENGERIIDQLWNTNQNFMEIMGQDSVKQAIQEHNGANVAQTGINETIDELYTSPQNKKAIRQILLVVDDIKKAVGYAPANIMMEFAREDRDDHRLIASRARQLEKTYQEISKNWFDNESVTQELKDQIKNKTKFTDRLYLYFIQGGIDLYTGHPLNIDQLSSYDIDHILPQSFLLDNSLNNRVLTSQAENRVHKEDRLPGETVANKMRPTWKMMREQGLMTQRKYNNLTLKPDQISKFNNRGQFINRQLVETRQVIKLAADIMSQKYQADQTKVVTVKANLTHHMREKFNFYKSRNVNDYHHAFDAYLTLFVGNWLLKEYPKLQPYFVYGDFAKTGTNNLKSFNFLYRFERDHKLNDKGAIDTDKDQQLGYMKRIYRFKKMLVTKQLETNEGALYGQTLYPAPKNDKKTRNLINSKKNRPSDIYGGYSNENGSFLTLVKLKKGSKYDYRLVAVPVSKISEIKESELATIEKAIAPQFLKSSGKYRDFQVVLSKILINQKVIDDGMIFTIGSKSYKHNAKQVVLSDNSIQIVSTLSRISDKEKLITVFDEIVDITSKYLPWYKVNDVEKTKMLFRQMQDIDEMKKIIDNSLIGLHCNASITDLGKVGLSKYWGRFVLTAGISLTVDAQLIYQSPTGLFEHRVKVSDL

SEQ ID NO: 283 - protein, 1391 aa, Lactobacillus gasseri
  Lactobacillus gasseri JV-V03
MTKIKNEYIVGLDVGTNSCGWVAMDFQNTILRMHGKTAIGSHLFDAGNSAADRRAFRTTRRRIKRRKWRLKLLEEIFDPYMTEVDPYFFARLKESGLSPLDKRKNVSSIVFPTALEDKKFYCNYPTIYHLRYDLMSEDKKFDLREIYLAIHHIVKYRGNFLYNTPVKDFEASKIDVKDSLEKLNELYERLDSEFTVELDSSNALEIEKIIRDKKVFKINKVKSIHQLLSLKTENKERTKLIKDVSKQIINAILGYKTKFETILLKNISKDEADDWEFKLTDVDADNKFENLIGDLNENEQEILLEIRNLANAITLSNIVEEGKTLSESMIDKYNKHSDDLELLKQVISDHPDRDKAKKLALAYDLYVNNRHGKLLQAKDVLGSKKTLSKEDFYKEVKKNLDDSKASQEILDTIALDSFMPKQRTNENGVIPYQLHQLELDRIIKNQGKYYPFLKEVNPVSSHLKEAPYKLDELIRFRVPYYVGPLISPNESTKNKQTKKNQNFAWMIRKEQGQITPWNFDQKVDRMASANKFIKRMTTKDTYLLGEDVLPANSLLYQKFTVLNELNNIKINGKRISVPLKEELYNNLFKKNSTVTTNKLKSYLKENYNLINVEIKGLADEKKFNSGLTTYNKLRNLKIFDQQLDDLNYDKDFERIIEWSTIFEDKAIYKDKLKTIKWLSDRQIDKLSKIRMQGWGQLSKKLLSQLTDNNGQTIIEQLWDSQNNFMQIVNQSDFKDAIAVANQNLLVNTSVEDILNEAYTSPANKKAIRQVVKVVDDIVKAASGKVPKQIAIEFTRDADDKAKISQTRANKLRKVYKELSNELASETIRNELERVAKDQKLLKDKYYLYFMQLGRDAYTGEPINIDDLGQYDIDHILPQSFIKDDSLENRVLVKKAVNNGKSDNVPVKLYGNRMAADLGMTIRHMWEKWKDQGLITKTKYNNLIIDPDKINKYESSGFIHRQLVETSQIIKLVSTILQSKYPDTEIIVVKARYNHYLRKHLNLYKSREVNDYHHAIDAYLSAICGNLLYQVYPYLRPFFVYGQYKKFSSDPKKEKIIYDKTRKYNFISQIFENKSNDIISLETKKKVFDKKDIIEKLKHAYNYKYMLVSRETETHDQEMFKMTVYPRLSRDTKKSRNLISKKKDMPTEIYGGYTNNSDAYMVIARINKKKGTEYRVFGVPMRELVNLRKAEKNGRYNAYLKQVLEPEIMYSKNGKKNKTISSFEIVKAKVPYKQVILDGDKKFMLASSTYVQNAKQLTLSQNSMQAITDNCENDTEEEKALEEKALIEAYDEILTNIDKYLPLFDINKFREKLHAGREKFINLSLDVKKDTILQVLNGLHDNAVMPKIKSLGLSTPLGFMQFSSGVPLSENAKLIYQSPTGLFEKRVKISDL

SEQ ID NO: 284 - protein, 1386 aa, Lactobacillus hominis
  Lactobacillus hominis CRBIP 24.179
MTKITEDYIVGLDIGTNSCGWVAMDSKNTILRMHGKTAIGSHLFDAGNSAADRRAFRTTRRRIKRRKWRLKLLEEIFDSHLAKVDPYFFARLKESGLSPLDTRKNVSSIIYPTSLEDKKFYVDNPTIYHLRYKLMTEDRKFDLREVYLAIHHIVKYRGNFLYNTPVKAFEASKIDVKGSLKKLNELYEGLDSEFNVELDSNNALEIENIIRDKKIFKINKVKEINQLLSLKTEDKERTKLMKDVSKQIVNAILGYKTKFETILLKDVSKDEADDWEFKLTDVDADNKFENLIGDLNENEQEILLVIRKLANAITLSNIVEEGKTLSESMKDKYKKHSDDLKLLKQVISDHPDRDKAKKLALAYDLYVNNRHGKILQAKDILEKKKTLSKEDFYKEIKKNLDDSKESQEILDAISLDSFMPKQRTNENGVIPYQLHQLELDKIIENQGKYYPFLKEVNPVSSHLKQAPYKLDELIRFRVPYYVGPLISPNESTKNKQTKKNQNFAWMIRKEQGQITPWNFDQKVDRMASANKFIKRMTTIDTYLLGEDVLPANSLLYQKFTVLNELNNVKINGKRISVPLKQELYNNLFKKNSTVTTNKLKSYLKENYKLIKVEIKGLSDEKKFNSGLTTYNKLKNLKIFDQQIDDPNYNKDFERIIEWSTIFEDKAIYKEKLKTIDWLSDRQIDKLSKIRMQGWGQLSKKLLSQLTDNNGQTIIEQLWDSQNNFMQIVNQADFKDAIAVANQNLLVDTSVEDILNEAYTSPANKKAIRQVVKVVDDIVKATSGKVPKQIAIEFTRDADDNAKISQSRANKLRKVYKEMSNELASETIRNELERVAKDQKLLKDKHYLYFMQLGRDAYTGELIDIDNLEQYDIDHVLPQSFIKDDSLENRVLVKKAVNNGKSDNVPVKLYGNRMATDLGMTIRHMWEKWKEQGLITKTKYNNLIIDPDKINKYESSGFIHRQLVETSQIIKLVSTILQSKYPDTEIIVVKARYNHYLRKRLNLYKSREVNDYHHAIDAYLSAICGNLLYQVYPYLRPFFVYGQYKKFSSEPEKEKIIYDKTRRYNFISQIFENKDNDIISRETKKKVFDKKDIIEKLKRAYNYKYMLVSRETETHDQEMFKMTVYPRLSRDTKKSRNLIPKKKDMPTEIYGGYTNNSDAYMIIARINKKKGPEYRVFGVPMRELVNLRKAEKNGHYKAYLKQVLEPEIMYSKNGKKNKTISSFEIVKAKVPYKQVILDGDKKFMLASSTYVQNAKQLTLSQYSMQAITDNCENDTEEEKALVEAYDEILTNIDKYLPLFDINKFREKLHAGREKFVDLPLAEKKETILQVLNGLHDNAVMPKIKSLGLSTPLGFMQFHTGVSLSENAKLIYQSPTGLFEKRLKISDL

SEQ ID NO: 285 - protein, 1369 aa, Lactobacillus iners
  Lactobacillus iners LactinV 11V1-d
MNNNYYLGLDLGTNSVGWAVTDDHYNIIKFHGKHMWGMRLFEEAETAKDRRLHRQARRRRQRLVERINLLEELFDKEISKVDQGFFARKKESDLHFEDKTTKSEYALFNDKSYTDRDYYKQYPTIFHLIMDLIENDKKRDIRLVYLACHYLIKHRGHFIFDGKNFTVDNSFENLLDKLITYLKDNDDITLSFPKDQLINIFKNSNLNSTEKSDQLKPFFGRTNLEKGIIKLLSGGKQDLSNMFRDETLKNSNYKNLKFSDNRFDDERDGYAADLGDRIDLLILLKQIYDASILESMMSQARVSIDGHKYISSAKVCAYEKHKSDLKRLKSLIKKYLPSEYNNIFRKITEKDNYVAYSKSNITNNKREKALKYVKYVDFTKYLTKKLKTIKTQDAEDDQEIFEIKGELEKQSFLPKQRTLDNSIIPYQLHLMELKKILDNQSKYYDFLLAKDDQEGITVKDKIISLLTFRLPYYIGPVNPAVHGKFAWVKRLANGKVTPWNYKEKIDIDASHEEFIKTKLSKCSFLIGCDVLPKNSLLYQKYMVLSELNTIKFNGVNISEKLKDDIYQNLFKNIQKVTKKRLQNYIKEHENIIGDVIVTGIDNAFKQGLVSYLKFKKIIGDKVDDDRYQKVLEKIIRDITLYDECAGKKIKKEYKDSDLFTEDELNKIVKLTFNDWGRLSAELLDQLEGEDTVSGETGKIIEFMQKHNYNLMQLMSKKFTFKSKIDEINKSYYQHDKFNYKSMIDSLYVSPATKRILWQSLKVVHEISKIMKHDPEKIFIEMARSKEDHPKRKLSRKADLKQVYKDSKKQIISIIGKDKYQDLSNELDNKDDRDLRWDNLYLYYTQLGRSMYSLKPIDISELMNKNLYDQDHIFPKSKKYDDSIENRVLVEKELNVKKSDIYPISDANIIPQKIKGQVESFWKMLYDHKLIGDKKYARLIRSKAFTDDELAGFIARQLVETRQATKETADLLKRLCPKSRIVYAKAQNASIFRQKFDIPKSRTINDLHHAQDAYLNIVVGNIFDTKFTQDPRNFIKNTKDSRNYNLEKIYDYNVERNNYVAWIAPDGETNGTIANVKCNLSTKDFRVTRPSFYKKGALFNQNLSRKGSNLAPIKEHSPKSNPLKYGGYSGKNNSFFVVVAGKDNKGKDIVKLIPVNTLIYNKMLHCDYKAKQELLTSYVANNFAINNFRIVKDDIKMYSLVKIDGAYYYLVGGTDERIEVKNAMQLLLSKDSIKAVKILEKESKDQFANIKNYKDIDIKLGRTFNEVVSKYTNSVFGKSMLISDKYRKDIFKSVEKSILEFNHLDTIGKADNLLKFVTLMRPSGSAHSLKMVGLIERIRKSNVISNFNEFKLINQSVTGLFENEEDLLKL

SEQ ID NO: 286 - protein, 1391 aa, Lactobacillus jensenii
  Lactobacillus jensenii 269-3
MKEIKDYIIGLDIGTNSCGYVVTDKQNNILKLKGKTAIGARLFKEGEAAADRRAFRTTRRRLARRRWRLSLLEEIFDEEMNKVDPSFFRRLKESDYSPKDRRKQFNSIVFESSEADKAFYEKYPTIYHLRNALMHDNQKHDLREIFLAVHHIVKYRGNFLREDSVKAFKAAKFTLQGEDGIGPVDKLNDLLKEIYIEAAPELATDNLSKIEDIIKDKKLYKQDKLKQIANLLPKAVDSKDKAKLNKDIAKQVANALMGYMFRLDTLFSFTDVDVKDYKLKFSDANIDESLDALTSLLTDAQIEFVLELQSIYNTIVLNEIVPDGMSLSESMVKKYDDHKKDLKLYKEYIDSLSDQKKAKQLEAAYALYVNYRKADLLAAKKLFEKKKIGDKKFVDVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNFEEMVDTTESANQFIKRMTRKDTYLLAEDVLPKSSLIYQKFMILDELNRIKIDGKKLTSKLKHDIFEKLFKKQKSINLDNLKNYLLAEGNIPGLIEGLSDGINFNNSFSTYIDYRNIFGDEIDNPNKQADFEKMIEWSTVFEDRKIFKRKLKEITWLTPEQIKQVSSKRYSGWGRLSKKLLTQITDENGVNILQRLWNEPETLTEVLANPVIKRKISEANSLFVQINKVENILDDAYTSPQNKKAIRQVIRVVDDIIAAAHGKKPSQIAIEFARSSQNKAKVPDTRKKQLDKIYNKISSEILDSSIKNELKNLKSNKYLSKDKLFLYFKQMGRDAYTGDKLSLDQLQNYDIDHIFPRSFIKDDSLDNRVLTQKPINAKKSDYGIPALEFGNKYVPDLGITVKEMWKLWQENGLISKSKLINLCTNPKKIGSKRASGFINRQLVETSQVIKLVAIILQAEFPDTEIIEVKALQNTTLRESFHLYKNRSVNDYHHAIDAYLTTIVGNYLYQVYPKLRPYFVYGQFKKFNQEKNIDILKRLKNFNFLRQLIFNTDDNIYISGTKEIVFNKKDIIHKLETAYGYKYMNISRECYQETSSLFNQTLYAHNSSVKNSLIPKKKGLPTEIYGGYSGNKDSFFVLVKIVKKRTNLYRIVGIPTRELAKLNSSNNYNQALNKIVESKLCLKETESFKILIKRLLYGTLIVDNGQKFRIGSFKEKHNVQQLVLQLKSMKYIKFYIDGGQNYFTDVERKKLEKQDRDKCLLYVFDDIMNVVNKRFTLFDMSKYEKDGDSLREKFNCLDFNDKVSILSDLLKAFHANSDRTSITKLKITNLGRHQAGKNGITLTTNAQIIYQSPTGLFERRIKIKDL

SEQ ID NO: 287 - protein, 1395 aa, Lactobacillus jensenii
  Lactobacillus jensenii 27-2-CHN
MKEIKDYIIGLDIGTNSCGYVVTDKQNNILKLKGKTAIGARLFKEGQAAADRRSFRTTRRRLARRHWRLGLLEEIFDPEMEKIDPNFFRRLKESDYSPKDSRKQFNAIVFKSIKADKRFYKKYPTIYHLRNALMHDNQKHDLREIFMAVHHIVKYRGNFLREDSVNAFKAAKFSLRGEDGIGPVDKLNDLLKEIYSEYSPELATNNLSKIEDIIKDKNLYKQDKLKQVATLLIKEADSKDKAKLNKDIAKQVANSFMGYMFRLDTLFSLTDVDVKDYKLKFSDANIDESLDDLTSLLTDAQIEFVLELQSIYNTIVLNEIVPDGMSLSESMIKKYDDHKEDLKIFKEYIDSLSDQKKAKKLLSAYNLYVNYRKSDLVEAKNLFKNKKVGDKNFADVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNLEEMVDTTESANQFIKRMTRKDTYLLAEDVLPKSSLVYQKFMILDELNRIKIDGKKLTSELKHDIFEKLFKKQKSINLDNLKNYLLVEGNIPGLIEGLSDGINFNNSFSTYIDYRNIFGDEIDNPNKQADFEKMIEWSTVFEDRKIFKRKLKEITWLTSEQIKQVSSKRYSGWGRLSKKLLTQITDENGVNILQRLWNEPETLTEVLANPVIKRKIVEANSSFTKAKDMKDILVEAYTSPQNKKAIRQVMRVVDDIIAAAHGKKPSQIAIEFAREDQDNPQMTKSRKAQLDQIYAKISDEFLDDAVKNELKNMKDNKPLAKDKVFLYFKQMGRDAYSGEKLSLDNLQDYDIDHIYPQSFIKDDSFDNRVLVQRAYNNGKSDNVPVLLFGNKIAAGLGITIRQMWKKWLELGLISKRKFNNLITDPEKISRNMASGFVNRQLVETSQVIKLVANILQAKLPDTEIIEVKASYNSILRKEFNLYKSREVNDYHHAIDAYLTTIVGNYLYQVYPKLRPYFVYGQFKKFGKAENQEDDPVKKIKKFNFIYQLIWGKDDAICISHTNQQVFSKKDIIDKLTTAYNFKYMNISHAVYTRNNNMFKQTLFPIIERTTAKTKSLIPKKLDRPTDIYGGYSNNNDAYLALVKVDKKRGSEYRVVGIPMRAAAMLKASKNYDEDLRKVIEPMVMFDKNGKAKRGIEGFRVLVGKMPFKQAVLDGNKKFMLTGTVDTPNLKQLVLSQQNMKYILDYIEDVDCRKHKFGDKVQNPDKCLLEVFDEIIEIVDKYFELFDSRDFREKLRNSRNKFIKLEASKKADTILAILKGLQAKSTRATIKELNISDFGRIITSSISPEAQLIYQSPTGLFERRVKVKDL

SEQ ID NO: 288 - protein, 1375 aa, Lactobacillus johnsonii
MTKIKDDYIVGLDIGTDSCGWVAMNSNNDILKLQGKTAIGSRLFEGGKSAAERRLFRTTHRRIKRRRWRLKLLEEFFDPYMAEVDPYFFARLKESGLSPLDKRKTVSSIVFPTSAEDKKFYDDYPTIYHLRYKLMTEDEKFDLREVYLAIHHIIKYRGNFLYNTSVKDFKASKIDVKSSIEKLNELYENLGLDLNVEFNISNTAEIEKVLKDKQIFKRDKVKKIAELFAIKTDNKEQSKRIKDISKQVANAVLGYKTRFDTIALKEISKDELSDWNFKLSDIDADSKFEALMGNLDENEQAILLTIKELFNEVTLNGIVEDGNTLSESMINKYNDHRDDLKLLKEVIENHIDRKKAKELALAYDLYVNNRHGQLLQAKKKLGKIKPRSKEDFYKVVNKNLDDSRASKEIKKKIELDSFMPKQRTNANGVIPYQLQQLELDKIIENQSKYYPFLKEINPVSSHLKEAPYKLDELIRFRVPYYVGPLISPNESTKDIQTKKNQNFAWMIRKEEGRITPWNFDQKVDRIESANKFIKRMTTKDTYLFGEDVLPANSLLYQKFTVLNELNNIRINGKRISVDLKQEIYENLFKKHTTVTVKKLENYLKENHNLVKVEIKGLADEKKFNSGLTTYNRFKNLNIFDNQIDDLKYRNDFEKIIEWSTIFEDKSIYKEKLRSIDWLNEKQINALSNIRLQGWGRLSKKLLAQLHDHNGQTIIEQLWDSQNNFMQIVTQADFKDAIAKANQNLLVATSVEDILNNAYTSPANKKAIRQVIKVVDDIVKAASGKVPKQIAIEFTRDADENPKRSQTRGSKLQKVYKDLSTELASKTIAEELNEAIKDKKLVQDKYYLYFMQLGRDAYTGEPINIDEIQKYDIDHILPQSFIKDDALDNRVLVSRAVNNGKSDNVPVKLFGNEMAANLGMTIRKMWEEWKNIGLISKTKYNNLLTDPDHINKYKSAGFIRRQLVETSQIIKLVSTILQSRYPNTEIITVKAKYNHYLREKFDLYKSREVNDYHHAIDAYLSAICGNLLYQNYPNLRPFFVYGQYKKFSSDPDKEKAIFNKTRKFSFISQLLKNKSENSKEIAKKLKRAYQFKYMLVSRETETRDQEMFKMTVYPRFSHDTVKAPRNLIPKKMGMSPDIYGGYTNNSDAYMVIVRIDKKKGTEYKILGIPTRELVNLKKAEKEDHYKSYLKEILTPRILYNKNGKRDKKITSFEIVKSKIPYKQVIQDGDKKFMLGSSTYVYNAKQLTLSTESMKAITNNFDKDSDENDALIKAYDEILDKVDKYLPLFDINKFREKLHSGREKFIKLSLEDKKDTILKVLEGLHDNAVMTKIPTIGLSTPLGFMQFPNGVILSENAKLIYQSPTGLFKKSVKISDL

SEQ ID NO: 289 - protein, 1382 aa, Lactobacillus mucosae
  Lactobacillus mucosae LM1
MDIGTNSIGWTAIDDHFSLLRVKGKNAIGVRTFKEGETAADRRGFRTARRRLSRRRWRLQFLDEFFAPYLAEVDPNFLARLKQSDISAKDPAKNQEYMGKLLFPDQEAASDGNGYPTLIQMRKAMPAEKAADFPVFNIYQLRYALMNEKRKFDLREIYLAVHHIVKYRGNFLNNTSVDKFKADQIDFNKSFETLNDLFRQVQPIAPFQIDLTKVDELGKLLLDTKQKKLDRQKAVAKLLPLIEDGTDKEIVKAHQQTAREISKLILGYKAKVGLILQNNLDQTLDMSTENSDDQLMQIAEELDDYQMELINQLSLLYSQIMLNEIVPNGETVSASMLNRYYKHRCQLKELKDYGAAQDKKTREQLDHLYAEYIGQIPKDSKFDFTKDLKKLMDKSDLGQKIKDEIEAGDYLPKQRTSANGVIPHQMHQQELDQIIENQKEYYPWLAEPNPVEKNIKNAKYKLDQLVSFRVPYYVGPMITLADQQKTSKASFAWAVRKKAGKITPWNFYDMIDREKSANNFIKRMTNKDTYLLSEDVLPASSLLYQKFTVLNELNNIRVNGRKLQPALKQAIYTDLFQKRKTVNLKTLTNFLAIHEPTLTKPKIEGLSNGRSFNSSLGTYIDMSKILGDSLDDLNYRDDIEKIIEWSTVFEDSEIYGVKLQEIQWLTNEQREKLVRKRYQGWGRLSKKLLTGITDENGQRIIDLMWDTSKNFMQIVHQPVFEEQIAELNQQLLQDADKAPLEVVDDILADAYTSPQNKKAIRQVVKVVADVVKAVGNAPASISIEFARNEDRNKELKNSRRHSIEKLYHETAEKLVKQTNLLEELGNVKDLNDRYYLYFTQAGRDMYDGTPINIDEISTHYEIDHILPQSFLKDNSLDNRVLVKKSENAAKSDRVPAKLYGAKMRAFWKQLKESQLISNRKYLNLTTDPEQVDKYQMQGFVHRQLVETRQIIKLAANIFGSLYPDSAVIETRAELTKQLREKFSLYKVRDVNDYHHAVDAYLTAFAGHYLYQRYPKLRPMFVYGDYAKIYADDLKRLRSVNLFHDLEKDQYNSGTAVNPETKEKIVDVDWLSDYVSKIQHFKYMLISKAVYTQHGQLYGATILPVAQVDKISAPIGIKDDKPVDIYGAYTNEVAAYMAIVRVNGKKPKYKVVSVPVRMLQRLKMAEQKGHDQYMQTLHDVLLRNFTSLKKNRKTGLKEAVVKDFDVLVPCVRYNQLVIDGDTKFTLGSATYQHNAKQLVLCNHSLETLANNFEYVRKHPDEADERMIMLYDDILDQVNHYFTLYDKNKFREKLNAGRDKYLKLPTFSQFENNKKTAIGKSEAIINILRGLHANAAITNLKCLGVSTPFGQLQSPSGIELSENAKLVYQSPTGLFSREVLLKDL

SEQ ID NO: 290 - protein, 1362 aa, Lactobacillus paracasei
  Lactobacillus paracasei subsp. paracasei 8700:2
MTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKANEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKGYPVDIYGGYFRENTAYLAVVKVTKKTETIFKVVKIATSQVAALNKARSRSTAEELSVLTELLKPKFSKVGKNGKITDTPFEVVLPRVPREQLFYNAKYGFFMVNSDTMFHNFQEIWVSRSDQKILQQIRKAKIDYPNVDQDLDNLFHNLADQIVKYFDLYSIAGFKEKISQSQNTFNDLAVDDTDQSVGKITVINELLKGAQANGMTGSLKVLKISTPFGFTQDKSGVLTKDSSIIYQSPTGLFERSVRLTDL

SEQ ID NO: 291 - protein, 1382 aa, Lactobacillus pentosus
  Lactobacillus pentosus IG1
MKKIVNYNLGLDIGTSSIGYAAIDDQGRPVRHQNKTVMGVRLFKEGKTAESTRIFRGTRRRLSHRHWRLGYLDRIFDNEIAKVDENFLPRLKASKRARSDEKRSFRGSLLFPETGDDAYYQKYPTIYHLRYALITQKKQFDIRLIYLALHHMIKYRGNFLDTTPVSAFNIHDIDLTDQFASLNDCYQLLDMDFEFQFDLNNIEQVQKLLLDETLSKTKRQAAVSKVLVMSTGNKAFDDQQNGIASEFIKALLGGPFDLSKILNLSVADVKSWKLHMTDKDVDDTLNSLVEELDENHKQIVNLLQMIYSQVMMLGLLNGQQSISASMIERYDDHAKHWAALKKLLPALGEQEQSTIIHAYTAYTGHSRTKQLSRAEFYTKVNSILKKHENIAEATGLIELIDRNEFMPKQRDAVNGVIPHQLHQRELQLIIQNQQKYYPFLAAKAYPDADETMIEQLLSFRVPYYAGPLVDRDFINESSDQEQAMQNTKFSWLKRREAGEITPWNFEQKVDVQETANRFIKRLTTKDTYLMTEDVLPKESLIYQRFEVLNELNAIRINDRRLTAENKQLAFQQLFMAGNTKNVSIKKFRNFVFDSLKFPEKVKITGFAGQHNFLAKLSTYHDFKKIFGERVDHTDLQPDFERIVEWCTIFEDRHIYREKLKEIQWLSQSEIDQLVLIRNHGWGRLSKRLLTGIRDSDGRTVMDQLWFGTDNFMRIISQSDFAAAIANENRTQLNQHGLEDVLDSAFMSPQNKKAIRQVLKVVDDIEQTLGCPPKKVMIEFTRSPDKKKQRTVTRLEKVQQAYKAVADQLAGQSIVSELDQYANTHSKLSDTYYLYFMQLGRDLYSGKPIDIDSPMLDDDHILPRAFMKDNSLDNRALTEKPINNTKAAKFPSKVFGQQKEVTDFWKLLRRCGLMSNIKEKHLYLDPDNVDKWTRRGFIHRQLVETSQVIKIVANILNDRYQQSQTEVLEVPARLGTELRECFGWYKVREVNDYHHVFDAYLAAFIGNYLYRRYPKLQPYFVYGNFAELNKAQLKNIKSFNFLYNITDNKRVVKDIETGQTLWDDQIRQQIQHIYEYKYMLTSHEAFTQHKELYGQTIYPRREFKPGTLKAIKQDQPQELYGGYKNLTAAYMCIVKIQARKRRAAEYRVVRVATESLSALQQAKRLGVQAYERCLRQELVRNNEILRTNADPNSAPREFEVLLDRVLCHQMIISDGQKYLLGSHAYKINCMQLVLSNNSMKILSTSIVKLKQMTNEPLVQVYREILDVVNKYFTLYDVNSFRENLNQFFDKFRTLPITNEYESSKSGKKLIHRGQLETLTLILRGLHANSDKVQYGDQSTLLGGFQTKDGIKLSKDSVIQYTSPAGLNVRTVKLRDLEQKEAQK

SEQ ID NO: 292 - protein, 1361 aa, Lactobacillus pentosus
  Lactobacillus pentosus KCA1
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDKEFYDDYATIYHLRDKLMTSNRKFDIREIYLAIHHIVKYRGNFLRTGPASQYGSASLHLATSFQKLNDLFAQSEETLNLKLVTDEALLQQIQQILVRTDLSRSEQQRQIWPLMAVLTGASAAEKKRQKNVVVELSKALVGLKAKMNVVTLTEVDAAVVKDWTFTMEESQDKLPEIEEQLSEVGQQIMDEVIQLYASVNLAQLIPAGKRFSQHMVEKYKHHEKNLELLKAYIHSQSDSKRGREIRATYDRYIDGVDSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDRKLAPQQKQRLYNQVFKQHQHVSVKNIQQNLMDAGEYRKTPQITGLADPKGFNSSLSTYHDFKKILLEAIADEHKRADIEKIILWSTTFEDSAIFKQKLEEVAWLTDAQRKQLSGLRYRGWGQLSHKLLTAFKDDKGRSIMDGLWETSDNFMQLRKQPAIETQIKEANQANLTDADIQDTINELYTSPQNKKAIREVMLVLDDIKNAMHGQTPSWIFVEAARGGGVAGRRTQSRSSQIVEAYKGTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPAASIVAVKANLTHQFRQTFNFPKLREVNDYHHAFDASLTAFIGMYLLKQYPKLERFFVYGKFAKQPINLTRFNIIRKLAVAEKPIANIETGEILWDKTADIKYFEKLYNYKRLLVTHEVRENYGAMFKQTLFKASYNKSKTLVPKKNHMETSVYGGYSNQETAYLAIVRIPFKSGFKFIVVGIPTRMVAKIKHYQSLGATLNQATHKVIEPKFTKISRKTKQTVISDYEVVLPKVYLDQVVRDQVKGQMYRFSLGSDKEYHNVQELYLPLSIQQAFVGHYDESDDQRSNDLVKVYDAALKQLQRYFPLHLSRNFDQVASQAHQSFEGLKNNVQTSDKQLGKKEVLNSLFVGLHANATRSNLSVLGMSKDFGRIKSNGITLTDQAEIIYQSPTGLFERKVALKDL

SEQ ID NO: 293 - protein, 1358 aa, Lactobacillus pentosus
  Lactobacillus pentosus MP-10
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDQEFYHDYPTIYHLRDKLMTSDRKFDIREIYLAIHHIVKYRGNFLRTGPASQYGSASLHLATSFQKLNDLFAQSEESLNFKLVTDEAQLQQIQQILVRTDLSRSEQQRQIWPLMVVLMGATAAEKKRQKDFAKELANALVGLKAKLNVVTLTNVDTTVVKDWTFTLEESQDKLPEIEEQLSEVGQQIMDEVIQLYASVNLAQLIPAGKRFSQHMVEKYNHHEKNLELLKAYIHSQSDSKRGREIRATYDRYIDGVKSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDQKLAPRQKQRLYNQVFKQHQHVSVKNIQQNLMDAGEYRETPKITGLADPKGFNSSLSTYHDFKKILPEAIADEHKRADIEKIILWSTTFEDSAIFKQKLEEVAWLTDAQRKQLSGLRYRGWGQLSHKLLTAFKDDNGRSVMDGLWETSDNFMQLRKQPAIETQIKEANQANLTDADIQDTINELYTSPQNKKAIREVMLVLDDIKNAMHGQTPSWIFIEAARGGGVAGRRTQSRSKQIVEAYKSTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPSASIVAVKANLTHQFRQTFNFPKLREVNDYHHAFDASLTAFIGMYLLKQYPKLERFFVYGKFAKQPINLTRFNVIRKLAVAEEPIANIETGEILWDKTADIKCFEKLYNYKRLLVTHEVRENYGAMFDQTIFKATDSRKRLIQKKKGFATETYGGYTGRTLAYLAIVKVVTNKDTQYQVVGIPTTMVTQIQQLEASGLTSKQAVTKAIGAMINENNKKLQSYEVLLPKVRFEQVVRDEVKGHIHRFALGTDTYYHNIQELYLPLTIQRAFLGKRNDTDAQTEQNLLTVFETTLAQVNRYFPLYEMNKFKQILNSAQEKFAALPTKNKTVKNKLVTGKDGVLNNLFIGLHANASLGDLKILGMKIGFGKLQVPGGLKLTDQAEIIYQSPTGLFERKVALKDL

SEQ ID NO: 294 - protein, 1358 aa, Lactobacillus plantarum
MKEPYGVGLDIGTNSVGWTVVDASGHVRKIKGQTGIGVRLFKEGAAAADRRGFRTTRRRLKRVKWRLRLLREFFDQPISKVDINFFARRKYSDVSPRDPNYNGLEKTLFNDRSDQDFYHDYPTIYHLREALMTQHRKFDVREIYLAIHHIVKYRGNFLRNDAATAYRSGTLDLQQHFETLNHLFSQADLELNLNLTTDVALLDSIKQTLVRTDISRSDRQKLIMPLLAVLTGATTAEKKRQKAVVTEFAKALVGNKTKIDVLTLTDIDATEAKDWAFSLEENQDKLPGIEDRFSEVGQQIIDEVIRLYASVNLAQLIPEGKRFSQSMVEKYKRHGEDLKLLKAYIRSQSDAKRGRAIRATYDQYIDGVKSKQVTQEAFQKALGKFVDADVDLNSWAAQIKQAIDSEQFMPKLRTKQNGAIPYQVQQNELDQIISNQKEYYPWLGEENPVIKRRGKFPYKLDELFGFRVPYYVGPLITKEMQAATANAGFAWMVRKADGPITPWNFDDKVDRVASATAFIQRMQTTDTYLIGEEVLPARSLIYQRFMVLNELNNIRVDDGQLTPRQKQRLYNQVFKKHKRVTAKNIQDNLVAAREFPTAPRITGLADPKVFNSSLSTYHDLKQVLPEAMSDVRKQADIEKIILWSTIFEDSTIFKQKLTEISWLTAAQLKQLGQLRYRGWGQLLRKLLTGLKDDNNRSIMDGLWETNANFMQLRSQPAIENQIKSANQANLTTADLQDTINELYTSPQNKKAIREVMVVLADIKDAMHGQTPNWIFVEAARGGGVAGRRTQSRSKQIVAAYQGTAQAIVRDQVQRELKEKIKNKANFNTRLVLYFLQNGRDLYTGDAINIDRLSEYDIDHILPQSLVKDDSLDNRVLTNARINREKNDTFASEKFGKKMGAKWKEMHRMGLMTKRKLDHLLMRPDEISKYATGFINRQLVETRQVIKLVEELINAEYPSTAIVSVKANLTHQFRQTFDFPKIREVNDYHHAFDAALTAFIGTYLLKRYPKLERFFVYGKFAKQPVNLTRFNVIRKLAKTDTPITDIDTGEVLWDKLTDIKYFETLYDYKRLLVTREVSENYGAMFDQTLLKASDNGKRLIRKKQSFDTAIYGGYTGKTLAYMAIVKVSTKKDVQYQVVGVPTTMVTQIEQLEQQGMTNKQAVTKVIEPLIAANNKKMLTYEVLLPKVRFEQVVRDRIKGQTHRFALGTDTYYHNIQELYLPLTLQRAFLGKQNESEVQLNQNLLTVFDATLAQVNRYFPLYEMNKFKKILNSARDQIELLEAKNQFVKNKLVLGKQGILTNMFIGLHANASYGDLKVLGVKIDFGKLQVPGGIKLTGDAEIIYQSPTGLFERKIALKDL

SEQ ID NO: 295 - protein, 1363 aa, Lactobacillus rhamnosus
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 296 - protein, 1361 aa, Lactobacillus rhamnosus
  Lactobacillus rhamnosus HN001
MTKLNQPYGIGLDIGSNSIGFAVVDANSHLLRLKGETAIGARLFREGQSAAERRESRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQEHYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAESRENVFAWMIRKDPSGNITPYNFDEKVDCPASANMFIQRMKNTDTYLIGEDVLPKRSLLYQKYEVLNELNNVSIDGRRLGADQKQRLIREVFERHSSVTIKQVAENLVAHGDFAKRPEIRGLADEKRFLSSLSTYHQLKKILHEAIDDPTKEHDIENIITWSTVFEDAAIFKTELAKISWLDSDTIKALSNIRYRGWGQFSRKLLDGLKLGNGHTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIVAKDTGEIVWDKERDIQELDRIYNFKRMLITHEVYFETADLFKQTIYAAKDSKERGGSKQLIPKKQGYPTQVYGGYTRENTAYLAVVKTVEKKADVYRVVRIATSQVAALKEARAQSTVKERELLKKFLTTKFTKIGKNGKKAITPFDIVIPRVPREQLFHNKRYGFFMVNSDTLMHNYQELWMSRSDQQILSKLVKSAKTVENGQVGRLFENIVEQINKYFPLYDINQFRKKLDQSKDIFSKLPLEGNGTTSGKRETIQNILTGAGTGAKNGDLKNLGIKTPFGFLQVPSGIVLDDDTTLIYQSPTGMLNRIVRLSEL

SEQ ID NO: 297 - protein, 1361 aa, Lactobacillus rhamnosus
  Lactobacillus rhamnosus R0011
MTKLNQPYGIGLDIGSNSIGFAVVDANSHLLRLKGETAIGARLFREGQSAAERRESRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAESRENVFAWMIRKDPSGNITPYNFDEKVDCPASANMFIQRMKNTDTYLIGEDVLPKRSLLYQKYEVLNELNNVSIDGRRLGADQKQRLIREVFERHSSVTIKQVAENLVAHGDFAKRPEIRGLADEKRFLSSLSTYHQLKKILHEAIDDPTKEHDIENIITWSTVFEDAAIFKTELAKISWLDSDTIKALSNIRYRGWGQFSRKLLDGLKLGNGHTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIVAKDTGEIVWDKERDIQELDRIYNFKRMLITHEVYFETADLFKQTIYAAKDSKERGGSKQLIPKKQGYPTQVYGGYTRENTAYLAVVKTVEKKADVYRVVRIATSQVAALKEARAQSTVKERELLKKFLTTKFTKIGKNGKKAITPFDIVIPRVPREQLFHNKRYGFFMVNSDTLMHNYQELWMSRSDQQILSKLVKSAKTVENGQVGRLFENIVEQINKYFPLYDINQFRKKLDQSKDIFSKLPLEGNGTTSGKRETIQNILTGAGTGAKNGDLKNLGIKTPFGFLQVPSGIVLDDDTTLIYQSPTGMLNRIVRLSEL

SEQ ID NO: 298 - protein, 1375 aa, Lactobacillus ruminis
  Lactobacillus ruminis ATCC 25644
MRKNQEPYNIGLDIGTSSIGWSIMNDNFDLMRVKGKKGIGVRLYNEGQSAAERRMHRTARRRYGRRKWRLRLLEDFFDEHMAEVDDTFFARLKDSNISPKDDKKYRKSLLFPKSKGVTYQDDGEFYKKYPTMYHLRYALMTEHRKFDLREIYLAFHHMVKYRGNFLYDTSVDSFEAKNLDIKGKFDEINDLLSSYTDFYVDNSNAALVESILLEKNTTRKDKSKKIAKLLHVEDKEKGKNKKAKDLATQISNAVLGLKCNFHLIFELQQKYSFDLCSEKTEENIAKLSEVLDENQKMLLMILKEVQDQVMLNAFVPSGMSLSEAMMQKYDDYGEQLKIYHELEHSVSDDSAAKLRGAYRDYNDNIIKRIDGDNKKDTFYKRVKNILTKISKEYVDQDVLESCGKLKKLIDENKLFIRQRTAANGVLPHQLHQIEMRKIIDNQKEYYPWLAEPNPNEKRRVYSKYKVEELIAFRIPYYVGPLVDPNNADKNKEARFSWMVRKKDGEITPWNFYDKVDWAESANNFIERMKSKDTYLLGEDVVPKESMLYQKYEVLNELNNLRINDSGLSDSFEDVKLKQAIYNDLFKKQKIVKITDLQNYLVQNHKYLVKPKISGLADENRFLSSLSTYSDLKTIFGDKVDDRTYFNDFEKMVEYSTVFEDGHDYNQKLDEYTWLTKEEKYKIGKKRYRGWGKLSKKLLTGLRDKNNHTIMDNLWETNRNFMQIQTADEFSKQIAEENERHLKGSVSDAINDMYTSPANKKAIRQVLRVVDDIQKAMGYAPSSISLEFAREDGPSVRTVSRANRMKSIYEKYASEVSEEVMKDLDGVIKDKKGLNDRLYLYFEQQGKDMYSGHPLDFDKVISGQEYDIDHILPQAVIKDDSLDNRVLTTKALNNDVKSKGVPCRMFNGMHSFWKNLYDKGFISRRKFNNLTTNPENIDKYKMKGFVNRQLVETRQIIKLVANVLNDKYQNDDVDIIEVRAELTHDVRKHFKFYKNRNVNDYHHAFDAYLTSFIGHYLFKKYPNLRPLFDYNDFMKVSDNVFKQLRGNNFLGEFLNKTGDIISTDGNFVLNKEEMINKLNKAYAFKKILVTKEVGQRTGAMFNETRYPAPNSRKAALKYRRMPKPDSLISVKDYKNTDIYGGYSGKNDAYMVIVDMGKQYMVVGVPVRYTEKLDKLRIKHSELYRDELRKVLSRDKTLLDSKGNVKRFDIVLDRVLYGQLIEDGNELFTLGSSKYKRNFRQLFLDKQCIEILDSSATPQPTDEELIWVYDQILDKVDKYFELYDINRQRETLRKGRAAFCSLPNISMKKDDVTKKKILNEILVALHANESESNCEKIGKKVFGRLQVPGGIKLSKEAKLIYQSPTGLFERVVYLKDL

SEQ ID NO: 299 - protein, 1339 aa, Lactobacillus salivarius
  Lactobacillus salivarius SMXD51
MERYHIGLDIGTSSIGWAVIGDDFKIKKKKGKNLIGTRLFNEGATAAERRGFRTQRRRLNRRKWRLKLLEEIFDPYMAEVDEYFFARLKSSNLSPKDSNKKYLGSLLFPDKSDSNFYDKYPTIYHLRRDLMEKDEKFDLREIYLAIHHIVKYRGNFLEKVPAKNYKNSGASIGFLLEEVNSLYKDIIGDESIAILNSEKFEDVEKIILDEETRNLDKQKSVGKLLVEDKKKKNIVTAFSKAIFGYKFNIEDLLLIENDEKNKLTFNDENIDDIFNELSHSLDDKQMDLLTKTREIYFKFKLNMIVPTGYTLSESMIEKYEMHKAHLKMYKEFINTLNTKDRKILKNAYSDYINTEKAKAANAQENFYKTVKKIIKDNNSDTAKKIIVLIDEGNFMPKQRTGENGVIPHQLHQIELDRIIENQAKYYPWLAEANPVEKNRKFAKYKLDELVTFRVPYYVGPLIDKTESNKNEKETKFAWMVRKAKGTITPWNFENLVDRTESANRFIKRMTSKDTYIIGEDVLPASSLLYEKFKVLNELNNIKVNEKKLDIEQKQDIYLNLFTTAKNVTKKSLATYLNCSADSISGLSDGEKFNSSLSSYIDLKAILGNIVDDCNKNEDLEKIIEYSTVFEDGNIYKEKLSEISWLTDEQIEKLSNIHFKGWGRLSKKLLTQITNENGERIIDALWNTSNNFMQIINDESIQAKLAEINGKYAGKSDLEDILSEAYTSPQNKKAIRQVMKVVEDIEKAMQCEPTSISIEFTRKKQKSRLTNTRYKKISDVYEKIADEVISEYELRKLQSELDSNANNMRDRYYLYFMQLGRDMYTGEKINIDELHQRYDIDHILPQSFIKDDSINNRVLTRKDVNNKEKSDKTAADLYAVEMSDFWRKLRKQGLITEQKYKNLLTKSDSIDKYAKKGFIKRQLVETSQVVKLVANILQDKYSDTKIIEVRAKLNSNLREEYKLIKNRAVNDYHHAIDGYLTTFIGQYLYKTYPKLRSYFVYNDFKKLDSNYLKHMKKFNFLWQLQDDKTIDIYDNVNNKFVLNVPEMKKYIQKIYNYKYMLVSKEVTTKNGAFYDQTKYNAKTVNLIPIKKNKPTNIYGGYKGKVSSYMMLVKIRKKKEVIYKFVGVPRLWTDELDRLKDTTERKILLNEIAKNSLSKTEQDFEVILDKVYYGQLIIDGNQKYTLGSSEYKYNAMQLHLSKHALEVLAKENVKDAEITDKDLVSVYEEILSVVNKYFELYDINKFRQKLNEGLEIFRKLPVYNVYESNKIKQVGKFEVLNRILMGLHANAMITDLKVLGIKTKLGQMQVNGGIKLSPDAKLIYQSPTGIFSRAVRVKDLG

SEQ ID NO: 300 - protein, 1331 aa, Lactobacillus sanfranciscensis
MNKQPYNIGLDIGTSSVGWSATELDNRLLHIKGHNGIGVRLFKEGESAADRRGFRTTRRRLARRKWRLRLLNEIFATEIAKVDPSFFARLKQSNVSPKDPNKTMFENILFDDENLDDQKFHHDYKTIYHLRQAIINHPEQKFDIRLIYLAMHHIIKYRGHFLNQANVQDFKGGKIDLEKSFKALNDIFENQGRDLRLVTDKANQYVKVLSDNAKTRSDRKKELSKLLYVPIDKDTDKNSKKVTGEILKAILGNKAKFDVIFGIEVENPKEWVLTFNSDDFDDKIEGLSSQMTDEDSEILLILKELYFALNLSDILNNSVTDKNAKTLSEAMINRYDDHKNQLAMLKKVIDSSDKKHAKELKEAYSAYIDGENNKKISFEDLKKRIQKNLVDSELSQKINDLLDHDYFLPKQRSKENGAIPHQLQQQELDQIIESQKQYYPFLAELNPNEKRSRQAKYKLDELVAFRVPYYVGPMVEVTDSNQENNGKFAWMIRKEQGEITPWNFDEKVDRTETATKFITRMTTTDTYLIGEPVLPKNSLLYQKFVVLNELNNLKINQEIITPGQKQYLYEHVMKKNKRVTLKKIADALVIKGDYPYAPEVKGTTDQKNLNNGLTTYIDLAKIFGNELDDVDREADFEKIIEWSTIFEDQHIFALKLQELKWLTEKQRNQVVKLRYQGWGKLSKELLAGLVDDNGQRIIDLLWSDNQNFMQIVNQKSFKESIADHNGAHLEEKNLKDVINDLYTSPQNKKAIRQVILVVDDIINAVGYEPANIMMEFAREDSNDHRLTNSRSRQLENVYKDITNSWFDNDSVKDELEDKIKNKDKFTDRLYLYFTQGGKDLYTGEPLNIDDLSSYDIDHILPQSFILDNSLDNRVLTSQRNNRVSKEDQLPGELFGTKMHAFWKRLKAAHLISNKKYYNLTLTPNSISKFNNQGRFINRQLVETRQVIKLAAEILHNRYSEEKGTNIVTIKANLTHHMREKFNFYKNRNVNDYHHAFDAYLTAFVGNWLLQQYPKLKPYFVYGDFAKTEINNLKSFNMLYKFEQAHQLNEKDGKIAKDADALLGYMKNVYHFKKMLVTKKLETNHGALFKQTLYPSPAHDIKKRQLIKPKDNRPTDIYGGYTHEERKYMSLVKVIGKKDNEYRMANVPLLKINKNNDIKEILKSQFSNKKFEIVLPKVLKNQLFSENGALFVIGSKGYKYNANQLVLSDLDMKLLNDLSNNKSIDEVTINQLFKNIVDSTNKYMPLYEIKNLNEVVEKFNNLEFNDKKKTITDFLLATHANPTMSNLKNIGLPSYFGRFTSGNAGIKLSENANVIYQSPTGLFSRKVKISDF

SEQ ID NO: 301 - protein, 1419 aa, Lactobacillus sp.
  Lactobacillus sp. 66c
MAKPQNYTIGLDIGTNSVGWTVTDDQNNILRIKSKKAIGARLFEEGKVAAERRSFRTTRRRLSRRKWRIKLLEELFDEEISKVDPNFFARSHESWISPKDKRERYSAIVFPTPEEDKKFHNEYPTIYHLRDRLMKDDQKHDIREIYVAIHHIMKYRGNFLHDESIETYRSGMSSLGGGDERTILNTKILDDLNDAFADNLATQGISVNSASADQINEIVTSGHLNVDSQKAIAKLLLPTTLSSDDKKQDKKIKKLATDAAKNVASAWLGYKANFAAILNIQEVDKDKKKIYSFALQGADEEDKVETLESVLSQDQIEIVDRIIRIRHAIVLGEIIPVGMTLSEAMIEKYDQHAKDLKNLKTVIRNLKDRKNAVKLQAIYDLYVNNRHADTAKAMKLAGVKKRTELLEPEEFNKSIEKLLDDSPVSAEIKKRIAEKDFLPLQRSNSNGVIPNQLHQIELDEIIKKQSKYYPFLGETNEHASADVARKAPTKLDQLLTFRVPYYVGPLITKEEQEEQDGHSFAWMIRKNPKDHEKITPWNFDEKVDRMASATQFIKRMTTKDTYLLGEDVLPSSSLKYQLFTVLNELNNLRINHKKLTREEKEQVIEDLFKKYKTVKADKFKNYWQKGHAGLDVKIQGMADPEKFNSTMSTYIDLQKIFGDQLDDAQRQNDFEKIIEYSTIFEDRKILGEKLRADFVWLSEDQIKRLCRLRLQGWGRLSLKLLTRLTDADGQNVLERLLNSNDNFMQIVKDPVIKAKIEQKNQKLLRADWSENATESILDEAYTSPQNKKAIRQVMRVVHDIVKACDGNLPAKFAIEFARSQDDDPKRTVARADRLQKIYAQISDEVVSQGVKDQLSGMKSLKDRYYLYFMQGGRDAYTGKPLNIDRLSDYDIDHIMPQSFIKDDSLDNRVLVTRAVNNQKSDNVPVLLYGNHLVADLGITIREMWDRWQKSGMISKRKLANLLTDPATLSEYRAEGFINRQLVETSQVIKLTATILQSEFPDSKIIEVPAKYNSILRKQFDLYKSREVNDYHHAIDAYLSTIVGNYLYQVYPNLRRLFVYGEFKKFSHGEEESSHQAVRRVKSMNFLDDLLRGKHGDDIYCRVTGEVIFSRKDIISKLKQAYSFKQMLVTQEVFTKKSALFDQTVYPSPARDSKTRSGLIPRKQGMDTEIYGGYSGNKDAYFVLAQVVKSKGHTLQVVGVPIRALRALANCSNYSEQLLKIVKAQVLFNKKTGKAKKGISDVRILLDKIPYRQPVLDGSAFYMLGSSTYKYNLKQISLSQQSMKYILDYIDDPNFNKHEMTKIDQQNEKECLLSVYDEILDKMDKYLSLYDINGFRKKLHVGRDKFIKLEVEKQAEAIKNVLRGFHANSDMTKLSDLGLSTSLGFMQASDGIKLSDNAVFIYQSPTGLFERRVKVSDLLK

SEQ ID NO: 302 - protein, 1289 aa, Lactobacillus versmoldensis
  Lactobacillus versmoldensis KCTC 3814
MRRRYRRRRNRLNWLDELFADELAKIDPSFLLRMKNSWVSKKESTRKRDPYNLFIDEKYNDVDYFNQYPTIFHLRKELITEDKKVDIRLIYLAIHNIIKYRGNFTLENQNFDISQLSSNFSQQISDFFALFSDFGVIMPEDFDPDKISDILLNPNLSPSGKVSEAIATISPKTNVKAKIKIILLLLVGNNGDLKKLFDLETTEKIAVKLSSRHIDSELPIILSELNEQQENIITIANSIFGSIILKDFLGDETSISAAKVISFEDHKQDLQKLKTMWRETSNKEAVKAGKKAYEDYIGHEDSETFYKKIKKFLEKAQPVDLANKALAEIELENYLPKQRNRNNTVIPYQLNENELIAILDHQEKYYPFLKENRDKILSLLTFRIPYYVGPLQDSNNNRFSWMTRKASGAIRPWNFSEKVNVEQSSNDFIKRMRSTDTYLIGEPVLPKKSLIYQCYEVLSELNNTRVKDGSSNPKRLDVTIKQRIYNEIFKNQKSVSVKVLQNWLIKESYFKSPEISGLADKKKYLSSLSTYIDFKKIFGQRFVDDPVNSPQLEELAEWLTLFEDKKILLIKLQNSKYSYDQATINKLSTMRYQGTGKLSKKLLVDLKTTKKSIGKSGAESLSILDLMWSTKDNFMQIIHDADYTFEQQIKEFNYDTEDELTPLEKVANLHGSPALKRGLNQSIKVVADIVKFMGHDPEKIFIEFTRSDDFSKLTISRYRRIKKQYLEIAKAIKKIPAEFKDIKEYQTQLEENKGKLASERLMLYFLQCGHSLYSNKPIDLNMINSSKYHVDHILPQSYIKDDSLENKALVLASENENKIDNMLISHDIIATNLPRWQALKDQNLMGSKKFADLTRTTVTENQKKGFIQRQLVQTSQIVKNITLILNDLYKNTSCIETRATLSSEFRKAFSNFDETTYHYQFPEFVKNRDVNDFHHAQDAFLACVIGEYQLKKYPKDNLRLVYDQYSKFLDSLKKDTRKKNGRMPRYTQNGFIIGSMFNGKTYVDDNGEIIWDQKIKESIRKTFNYHQFNVVRQTIEQHGKLFNDTIQPHSDRYKLIPLKTNRDPAIYGGYNNDNNAYSVVLDVDGKKKINGIPIRIANQLKSDELDLSSWLENNIKHKKPMTILIDKVPKYQRIINEETGDLLITSANEVINNVQLFLPSMYTALISLLDSTKTEMYSKLLSNYEANILIDIYDYLLTKLKNNYPLYRKEWAKLAEHRDDFIESDLVTQASTLQQLIKFMHADPSNVNLKFGNFKGNRFGRKNGNIKLSKTDFIYESPTGLFKSIKHID

SEQ ID NO: 303 - protein, 1372 aa, Legionella pneumophila
  Legionella pneumophila 130b
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKNFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGGSSDKTLEQAIEKQNIQWEEKFQRIINASMNICPYKGASIGGQGEIDHIYPRSLSKKHFGVIFNSEANLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 304 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 305 - protein, 1355 aa, Leuconostoc gelidum
  Leuconostoc gelidum KCTC 3527
MTYSIGLDIGTGSVGWAVIGDDYRLKRAKGKNLIGVRLFDSATTAAERRGYRTTRRRLSRRHWRLRLLNDIFASDLAEQDENFLPRLKYSWVNPDDEQNPQLNSDVANGALFGSSETDKAFHKNYPTIYHLRHELMTDTAKHDLREVYLAIHHIVKYRGNFLNTADKINAENSFNVDLFIAALDEYNEFLETPITSIKDAQLFSDKLTDINARNKSVRVENAMSETYDDKSKIFKAILTALVGNTANFQTIFDLSDLEKDEAKNFKFKLDLEDVETKLDVVRAKLSDEQNAFLEAVLIAYDGITLKMILGDYKSISQSMIESYKSHQRDWKYIKNNVRLNEQKIEPDKNSVKFFKLDPKKLIYPSNLAYLQVISSNEDEHRKGLDYFKTAIQDADILQRIENDTFLPRQRTKRNGVLPYQLHLAELEQIIKKQSKYYPFLANIYTQDNKTENKLIGLLKFRVPYYVGPLVEAEKVTGDGKNHWLIKKELQENTPITPFNFDDVVDKDKSGEQFIKRITGTDSYLIGEPTLPENSLLYQKYNVLQELNNVRNERHQRLPIKVKQDIFEHVFKIDKNVNAKKVMAYLKLNGYGDFQIAGLSDTRTGKFNSNLSSYNYFVDLLGREKTEKIREDRLEEIIEIQTVFEDKILVAKRLSNLDFLTPQEKSKLSAKHYTGWGRLSQKLLTTQFIKTALSEAGDIIPQSHSIIDLLYYTDKNLMEILNDKTFNVRNWLTEQNKGTESGNSLYDQIDALAGPKDIKRGITQVFSIIDDIKKAMGSNPETVYLEFARETQTSRLTNSRLNRVQEIYNSPELKTEFAYLAKKLEAETKESIHDDRLYLYYLQEGRDMYTGKEIPFDQISSNYDIDHIIPQAFTKDDSLDNRVLVNRATNARKSNSPTFTNDIIDNRKSWWQSLVKRGLMSKEKFERLTDKRKTFSENQTNHFIARQLVETRQIIKNVADLIKNNYDGTQAVAIRASLTGEMRRYLDWPKNRDMNDYHHAHDALMMATVGKYVDRRGFFDNGSVSDGAGNAYNLYTKDWLVAARVGTRNDSQRVNPYGFIVGSMNSKAVRQQVNKETGEIVWGNENLDYLRHVLSYKKILVTRRLSGSSGRLYAETLFSPNPKAKLIAQKANRSVALYGGFTKAESAYTALVEFNKKGDRSYKLIKVPMAIANRVNDKQITVTAYIASLNLRDFSRVVLEHLPLGTLIRESDGSEFYAASSEYKHNAKELWAPKEILRSSKKLDKATADNLIDIFDFLTNDKTISNFKFYEKDLLHLKNVRDKFVEASDEIKIKVLSDVIYELHNDAGWRDPFKHIQEKPAWTMLQVKGGIKLSEKAAIVYQSPTGLFETITIVGE

SEQ ID NO: 306 - protein, 1337 aa, Listeria innocua
  Listeria innocua ATCC 33091
MKNMKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 307 - protein, 1334 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 308 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 309 - protein, 1334 aa, Listeria monocytogenes
  Listeria monocytogenes FSL J1-194
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPMKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 310 - protein, 1334 aa, Listeria monocytogenes
  Listeria monocytogenes FSL J1-208
MKNPYTIGLDIGTNSVGWAVLTDQYDLVKRKMKVAGNSDKKQIKKNFWGVRLFDEGETAADRRMNRTARRRIERRRNRISYLQEIFALEMANIDANFFCRLNDSFYVDSEKRNSRHPFFATIEEEVAYHKNYRTIYHLREELVNSSEKADLRLVYLALAHIIKYRGNFLIEGALDTKNTSVDGVYKQFIQTYNQVFISNIEEGTLAKMEENTTVADILAGKFTRKEKLERILQLYPGEKSTGMFAQFISLIVGSKGNFQKVFDLVEKTDIECAKDSYEEDLEALLAIIGDEYAELFVAAKNTYNAVVLSSIITVTDTETNAKLSASMIERFDAHEKDLSELKAFIKLHLPKQYEEIFSNVAIDGYAGYIDGKTKQVDFYKYLKTLLENIEGADYFIAKIEEENFLRKQRTFDNGAIPHQLHLEELEAILHQQAKYYPFLKEAYDKIKSLVTFRIPYFVGPLANGQSDFAWLTRKADGEIRPWNIEEKVDFGKSAVDFIEKMTNKDTYLPKENVLPKHSLYYQKYMVYNELTKVRYIDDQGKTNYFSGQEKQQIFNDYFKQKRKVSKKDLEQFLRNMSHIESPTIEGLEDSFNSSYATYHDLLKVGIKQEVLENPLNTEMLEDIVKILTVFEDKRMIKEQLQQFSDVLDGAVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKVVFEKKIIRITIMERKAFEKDEKSFLEKQGYRQPKVLTKLPKYTLYECENGRRRMLASANEAQKGNQQVLKGQLITLLHHAKNCEASDGKSLDYIESNREMFGELLAHVSEFAKRYTLADANLSKINQLFEQNKDNDIKVIAQSFVNLMAFNAMGAPASFKFFEATIERKRYTNLKELLSATIIYQSITGLYEARKRLDG

SEQ ID NO: 311 - protein, 1334 aa, Listeria monocytogenes
  Listeria monocytogenes FSL N3-165
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEEASLKKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGKTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTTDKDLQSIVAELAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFGWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECKNGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 312 - protein, 1334 aa, Listeria monocytogenes
  Listeria monocytogenes FSL R2-503
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPVKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 313 - protein, 1334 aa, Listeria monocytogenes
  Listeria monocytogenes serotype 1/2a str. F6854
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHDNYRTIYHLREKLVNSSEKADLRLVYLALAHIIKYRGNFLIEGALDTKNTSVDEVYKQFIETYNQVFMSNIEEGALAKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTILENIEGSDYFIAKIEEENFLRKQRTFDNGAIPHQLHLEELEAIIHQQAKYYPFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKIRYIDDQGKTNYFSGREKQQVFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILYQRFNKETDNHGNTMEQVRIVTLKSALVSQFRKQFQLYKVREVNGYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 314 - protein, 1087 aa, Listeriaceae bacterium
  Listeriaceae bacterium TTU M1-001
MKKLVLGLDIGVASVGWGIIDAENGDVVDTGVRLFSSRDASENESRRTSRQSRRLSRRKKHRRERIKQLLLAHDMDICDIVNENPYELRVKGLNEKLEVSEIYVALTHLAKRRGVSYLDDVVEEGGTIKSEHLNKNMEEIKSGKMPCEIQLERFEKYGQVRGMIEINQDTEESSFLVNIFRTSDYIKEAKTILATQQKFHKQITNEFIDEYIHIMASKRDYFIGPGNEKSRTDYGVYRTNGDTWDNLFEILIGKCSVFPEETRAARSSYVAQEFNLLNDLNNLKISNLESGKLSASQKHDIVEKVKNSKKFGTKDLLKYIASVCECKIEDIGGCRVDKNRKPIMHTFENYRKVHNALNEAGVDLRLSETDYDELMKIMTLNSETLEIKKQCKEKLPQLTEDYLNVCLVLNKKGAFSGWHALSLKAMKLMMPELYGTSKNQMQIIHTMQLGKAYLKPLNQQKYLNSEAILEEIYNPIAARSIRQTIKVTNAILKKYGHLDSVIIEMPRDYQTSEDERKMIEKMQKENEKEKKAALKRAREEYPFPDEAFRNHKELATKLRLWYQQDQFCVYSGRKISVVDLVRNPNQFEIDHIIPQSVSLDDSLNNKVLCFSEENQKKGQQTPFYYHKGKSGNWTYEQYKLFVEKLFDKKKISNKKRELLLFEEDINKWDVRRGFIARNLVDTRYASRVILNSYQQYFGNHEMGTKVKVVRGKFTSQLRKKWRIFKDRNESHSHHAIDALIVAATANLRLWKKNTLGVSDEGKVYDKETGEILPFEKLTESEYNEMMNKEPYLNFKTKLQNIETKVKYSYRVSKKVNRKISDATIYSTRERDGIDYIVGKIKNIYDVKTYKDQFLKRYKKNKEQFLMYQHDPQTFAILENIMATYQDAENPFLAYKKEYGVIRKYSKKGGGSPVTSLKFIDKVLGQKIDLTAKNQAALPKNKKVVLQSITPYRADVYYDEIDKRYHLIGVKYSLFSFSKQGYVINPIAYQKLLEKEQIHSEMKFCFSLYREDIIEFGEDPDSLTRYRFWSKNESGKNKIEVKPIEKPNFEKQTVLTITKKIKILNKYQTDVLGNSFKAQEEKDPRNIE

SEQ ID NO: 315 - protein, 1345 aa, Marinilabilia sp.
  Marinilabilia sp. AK2
MKKILGLDLGTTSIGWAFIKEPEKDVVGSEIVDMGVRIVALSSDEENDFAKGNTISINADRTLKRGARRNLQRFKLRRDALLEIFKEMKLIPSNFKYAEDGPSSTFSTLKLRDKAAKEKIELDDLVKVLLQINKKRGYRSSRKAKSEEDDGSAIDSMGIAKELYENDLTPGQWVFEALQKGRKNVPDFYRSDLQEEFKKIVNYQSEFYPDVLNSSFVEDWMGKASTPTKQYFNKKGVHLAENKGKREERRLQEYNWRAVAVNSKIDLSEIALILSQINSQISNSSGYLGAISDRSKELYFKNQTVGQYLYQQIKINPHTRLKGQVFYRQDYLDEFEKIWSVQSGFHPQLNDALKKEIRDITIFFQRRLKSQKHLISNCEFEDYHKVVPKSHPIFQEFRIWQNLNNLTLIKKDNLNEKSELALEDKIALANELAFKREQSVKDALNILGLKSSEWEFNFTKIEGNRTNHAFFEAFAKIIEIEDGEPLDLGNLKADDILDQFSEAFLRIGIDPGLLQVNNDIEGPNYEKQPYIQFWHLLYSSEDDQKLKQNLIKKFGFKPDHAKILASISLQDDHASLSSRAIKKILPHLQSGLIYDKACTYAGYNHSSSFTKEENEKRELSSELDLLKKNSLRNPVVEKILNQMINVVNAILKDPNLGKPDEIRVEMARELKANAEQRKNMTSNIASATRDHEKYREILKKEFGLKRVTKNDLLRYKLWLETDGISLYTGKPIEASKLFSKEYDIEHIIPKTRLFDDSFSNKTICERQLNIDKANVTAFSFLQNKLSGDEFEQYQSRVKSLFGKLSKAKIQKLLMANDKIPEDFIARQLQETRYISKKAKEILFEITRRVSVTTGTITDKLREDWGLVEIMKELNWEKYDKLGLTYTIEGKHGERLNKIKDWSKRNDHRHHAMDALTVALTKPAYIQYLNNLNAKELNGKKSTEIFAIEQKYLKRENGKLCFIPPVENIRTEAKKHLSKVLISYKAKNKVVTINKNRTNKKAGFNEQIALTPRGQLHKETVYGKAFHYSTKFEKIGASFDVQKINAVAKKEEREALLKRLAENGDDPKKAFTGKNSLSKMPIYLDLKRNIKLPEKVKTVVLEQNYTIRKNIDPDLKLDKVIDVGVKRILENRLKEFGGNAKLALSNLDENPIWLNKEKGITIKRVKISGVSNVESLHVKKDHFGEPILDQVGNEIPVDFVSTGNNHHVAIYEDEKGNLQEEVVSFFEAVVRQNQGLPIINKNHSLGWKFLFTLKQNEYFVFPSDDFDPTDVDLMDEENYHLISPNLFRVQKFTTKDYFFRHHLETTVEDKSELKGVSFKRLGLPGLNCIKKIRINHLGKIIQVGEY

SEQ ID NO: 316 - protein, 1352 aa, Megasphaera sp.
  Megasphaera sp. UPII 135-E
MKKRNREEYYVGLDIGTSSVGWAVATPDYRIPKFRGHKMWGSRLFAEGKRAAERRQFRTNRRRLARRRDRLQILEELFAEEMAKVDNTFFMRLKESKFFLEDKTVKEKHILFSTDKFDADRFYKDNPTIYHVRKRLMEEEPQDIRELFLAVHHILKYRGHFLFAGSLEQNGASIEELVRTLLGKQGLAILDDTIDSNEMVNILKNTGETKSDRKKDVQELWNPLKDKVKKAQAAEMAGLVLGLKSDISKLFANSDYKDLDSSIKNINFSSGDYEEKRDDYANSIGDDIVLLDTMKALYDTLILSQILQGKRSISAAKVEDYNTHKEQLRALKAILKPHKRLYNEMFRENNKKDLSNYVAYISSYSEGKRVNREGFYKYVQAVLKQVDDSDSKQAILEAIRLETFLPLLRVKDNAVIPHQIHQAELEAILETARKKYNFLNDVSDGVSVKDKIIQLFTFRIPYYVGPLNPHSGETVADRKQGTGWVVRKQRGKVYPWNFADMVDVKASAEAFITNLTNKCTYLIGEDVLPKRSLLYSEFMLLNELNMIKYDGHELPVAIKQLYIEQVFKQEHKKQTKGRVLDFLKRNGLITGSATAVITGMDDAIKGDLQSYRDMVRIFGAGFDHSMAERIIRWVTLFGEAKDILENKIREVYGNSISDSQMRAIKKLKYADWGRLSQAFLIAVKGCDKSGVERNIITCLRASSQNLMEILSDQGTYIKQIKAWNHQHTTNMMDTLDYQLVDDLYVAPSVKRSIWQSLCIVEELVKIMGQAPKKIFVEVTRTKQAEKTKKDSRKKRLVELYTAIGKEGAAWKKEIEAHQAGDFRRKKLYLYYTQMGRCMYSNEPIAMDALFTSAYDIDHIYPQSLTKDGSWDNLVLVKSQLNKEKSDQYPLRPAIREKNKAHWQYLCRAGFISEKKYERLMRTTELTAEELSGFIARQLVETSQATKAVTGLLERIYTNTEICFVKAETVSQFRHQHNFIKIRELNNYHHAKDAYLNIVVGNVYHEKFTKNPWEFIARSTERRPYNLNRMYDFDLLKQGRVIWQVPKSLETVQAMMKSNDVRITKKLLVQKGELYDATITKAHKAKEGTYFPLKGADARLRDVHRYGGYEKIKIAYYSVFSCREKASNTIHTLIIPIPVYKAGLLQTEADLTAYAWQTKQKTKPIKDIYSAITPIYKKLCINTVVKIDGFKYFLGGKTGDYMWLDPAIPVVLDEQAAAYLKAISKVGRADDVENTAQAIDLITAEANEAFYDVLLKKMEAKIFAKAYQTIVEKLASETARERFRELSIGAQCSCLLEILNLLANNKTTFTFFKDKMGVTMSRRKQPMDLTKLEECIVYETSITGLYEKAVSLL

SEQ ID NO: 317 - protein, 1080 aa, Methylocystis sp.
  Methylocystis sp. ATCC 49242
MRVLGLDGGIASIGWALIEIFEDHEPSDGRIIDTGAWMFDAPEEKSQTGTKLKSELRRIFRGQRRVIRRRRQRMNEVRRILHRHGLLSSDNRDALKQPGLDPWKIRAEGIDRLLSPIEFAVALGHIARHRGFKSNSKGAKTSDLDAESSRMKKAVGETREKLARFGSPAKLLVEDEGFVLRQTKLKSGALETVRRFRNRDGDYSRSLLRDDLAAEVRALFRAQARLQSTFAKVELEAEFTQAAFFQRPLQDSERLVGPCPFEPAEKRSPKRGYSFELFRFLSRLNHLTLREGSEERTLTVEELRTAAADFGGVAKFTFSTLRKRLALPDIAIFVGIKADDEKKLDVVARSGEAATGTARLRRVVIDALGELAWGALISAPERLDKITEIITFRSDLDRIRAGLIEAGFDTPLIEAIVRAAADGKLDAFTGVGHISAKAARNIIPGLMRGMTYDKACAAAGYDHTASRERDAFDVGMHGKEALKKILQEERISRELVGSPSARKALIEAVKQVKAIIEKYGVPDRIHVELARDVGKSIEERRDIHFGIEKRSRQKDKLRELFGKEVGHLPQDGERGKEELLRFELWNEQMGRCLYTDEYINPKQLVASDNSVQVDHILPWSRFGDDSYLNKTLCTAKANQDKKGRTPYEWFRADKPEAEWDAFVARVESIQFMKGLKKRNYKLKNAEEAAEKFRSRNLNDTRWTCRLLAEALKQLYPKGEKDKDGKERRRVFTRPGALTNRLRRAWSLQRRKKSEKGERIADDRHHALDAIIVAATTESLLIRATREVQDIERKGLHYDLTKNITQPWPGFADEALDAVEKVFVARAERRRARGKAHDATIRHIAVRDDEAKVYERKKVGDIKLGDLIRVKDAERNAPLIENLRKWIEAGSPRDNPPLSPKGDPVSKVRLVTKNKVNITLDTGNPERLATVDRGEMARVDVFRKANRKGKYEYYLVPIYPHEIATMETPPMRAVQGGGDDDKWPEIDSTFEFLWSINQLSLLELTKPDGEVIRSYFRSLDRNTGALTVSGIANSTATRKGIGTRTLIDFKKLHVDRLGQIFEVERELRTWRGETWRGKDCI

SEQ ID NO: 318 - protein, 1082 aa, Methylosinus trichosporium
  Methylosinus trichosporium OB3b
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 319 - protein, 1123 aa, Mobiluncus curtisii
  Mobiluncus curtisii subsp. holmesii ATCC 35242
MFVYLNSPRGFGPATFLTDLPHFCIIFGNNDFMDNRKYHVGIDVGTNSVGFAAVEVGDSGSPIRFLNTMVVIHDSGVDPEQKKYAITRLASAGTARRTRRLYRTRRQRLRELDDFISNELGYPLVNLENFADPYEPWKVRADLATIKLPADELPEAMSIALRHMARHRGWRSPYQRVEALHLHAEISEEFSALKKRVMEKTGDVFSDDATPAEVLVDLMGRQKIRGADGMLSGKLRQSDNANELRKIASVQGIDDETLNRIIDRVFFSRSPKGKASERVGMDALPGQGSKPRALKAMPSFQKFRIVSVICNLRIKDSGDDNRPLSMEEKEQLIGYLMSSTTDDHVTWTDVAELLHVKRSNLQGTAKEGPDGERPYTRPPVNSAWSKIKDSKIKSLVALWKTGDVDVQSAIVEALSNASVLEDARPGADIVVAYLESLDDKELESLDKVGLPAGRASYSEDSLERLTERMLQDDCDLFEARKREFGVSDDWKPPADPIYAPVGNPGVDRVLKIVNRLLMAAEREWGAPTQINIEHVRSGFSSELMQREFERENERRRAQNEEAVKAILTEKGGNSHVSKYDIIRYYAVKRQNCQCLYCGTPITFSDCELDHIVPRKGVGSTNSRVNLAAACRSCNRDKSNLPFAVWAGKTSNFDVSIDGAVSRVKQWQRSQNEGAREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETAREHFAVWKSNMERLTDLFNDKLENDAIPVVQPLRLRLSDSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKIFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILSGQGWRPAINVLFSKGKPRIVRRNSLGIERPSSNNGLPFSWEA

SEQ ID NO: 320 - protein, 1091 aa, Mobiluncus mulieris
  Mobiluncus mulieris 28-1
MDSRKYRVGIDVGTNSVGFAAVEEDDSGSPTRFLNTMVVIHDSGVDPEQKKYAITRLASAGTARRTRRLYRTRRQRLRELDDFISNELGYPLVNLENFADPYEPWKVRADLATTKLPNDELPEAMSIALRHMARHRGWRSPYQRVEALHLHAEISKEFAALKERVVEKTGDVFSDDATPAEVLVDLMGRQKVRGADGVLSGKLRQSDNANELRKIASVQGIDDETLNRIIDRVFSSKSPKGKASERVGMDALPGQGSKPRALKAMPSFQKFRVVSVICNLRIKDSGGDARPLSMEEKEKLIDYLMSSTTDDHVTWTDVADLLHVKRSQLQGTAKEGFDGERPYTRPPVNSTWSKIKDSKIKSLVALWKTGDVDVQSAIVEALSNASVLEDSRPGADIVVAYLESLDDKELESLDKVGLPAGRASYSEDSLERLTERMLRDDCDLFEARKREFNVADDWKPPADPIYAPVGNPGVDRVLKIVNRLLMAAEREWGAPTQINIEHVRSGFSSELMQREFERENERRRAQNEEAVKAILTEKGGNSRVSKYDITRYYAVKRQHCQCLYCGTPITFSDCELDHIVPRKGVGSTNTRVNLAAACRSCNRDKSNLPFAVWAGKASNFDVSIDDAVSRVKQWQRSQNEGVREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETARKHFAVWKSNMERLTDLFNDKLENDAIPVVQPLRLRLSNSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKTFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILLGQGWRPAINVLFSKGKPRIVRRNSLGIERPSSNNGLPFSWEA

SEQ ID NO: 321 - protein, 1091 aa, Mobiluncus mulieris
  Mobiluncus mulieris FB024-16
MDSRKYRVGIDVGTNSVGFAAVEEDDSGSPTRFLNTMVVIHDSGVDSEQKKYAITRLASAGTARRTRRLYRTRRQRLRELDDFISNELGYPLVNLENFADPYEPWKVRADLATTKLPNDELPEAMSIALRHMARHRGWRSPYQRVEALHLHAEISKEFAALKERVVEKTGDVFSDDATPAEVLVDLMGRQKVRGADGVLSGKLRQSDNANELRKIASVQGIDDETLNRIIDRVFSSKSPKGKASERVGMDALPGQGSKPRALKAMPSFQKFRVVSVICNLRIKDSGGDARPLSMEEKEKLIDYLMSSTTDDHVTWTDVADLLHVKRSQLQGTAKEGFDGERPYTRPPVNSTWSKIKDSKIKSLVALWKTGDVDVQSAIVEALSNASVLEDSRPGADIVVAYLESLDDKELESLDKVGLPAGRASYSEDSLERLTERMLRDDCDLFEARKREFNVADDWKPPADPIYAPVGNPGVDRVLKIVNRLLMAAEREWGAPTQINIEHVRSGFSSELMQREFERENERRRAQNEEAVKAILTEKGGNSRVSKYDITRYYAVKRQHCQCLYCGTPITFSDCELDHIVPRKGVGSTNTRVNLAAACRSCNRDKSNLPFAVWAGKASNFDVSIDDAVSRVKQWQRSQNEGVREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETARKHFAVWKSNMERLTDLFNDKLENDAIPVVQPLRLRLSNSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKTFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILLGQGWRPAINVLFSKGKPRIVRRNSLGIERPSSNNGLPFSWEA

SEQ ID NO: 322 - protein, 1473 aa, Mucilaginibacter paludis
  Mucilaginibacter paludis DSM 18603
MKNILGLDLGTNSIGWALIEKDTDQKNGNILGTGSRIIPMSQDIKDEFGKGNSISQTADRTKFRSVRRLRERHLLRRERLHRVLNVLGFLPKHYADQIDFKKRLGKLVNETEPKLVYDNKNFIFKKSFEAMLSDFNQHQPLLLADGKKVPFDWTIYYLRKKALTEKIEKEELAWLILNFNQKRGYYQLRGEEEEENPNKMVAFHSLKIVEVIADESQKGKAETWYSLILENGWIYRRSSKTPLYDWKGKQRDFIVTTDLNDDGSIKTDKEGLEKRSFRAPVEDDWTLVKKKTEQEINRSHKTVGTYIYENLLQDPKQKIKGKLVRTIEREFYKDELKMILKNQQKFHPELNDEHLYINCVRELYRNNQAHQTILSKKDFVHLFIDDIIFYQRPLRSQKSSISNCTLEFRKYKNENGTDQTDYLKAIPKSHPLFQEFRLWQWIYNLGIYQKEDDTNVTDELIKNIDGYQDLFDFLNNKKEIRQDILIKFLVEQTGLKGKPLSSVVAKYRWNFVEDKIYPCNETGTQIRTRLAKVENTPEDFLTAETEIKLWHIIYSVNDKADYEKALKTFAEKHNLDTHSFVENFKKFPPFKSEYGSFSEKAIKKLLPLIRLGKYWSWENIDKKTQERIEKILTGEFDEAIKSRVRDKAIHLTEEDHFQGLQLWLASYVVYGRHSEADNLDKWHTVADLEDYLAEFRQHSLRNPIVEQVITETLRVVKDIWLQYGQGAKDFFSEIHIELAREMKNTGDERKRLTSLVTDNENTNLRIKVLLSELLNDGNVENVRPYSPMQQEALKIFEDGVLNSDIEIEDDILKISKMAQPTNTELKRYKLWLEQKYRSPYTGQIIPLNRLFTADYEIEHIIPQSRFFDDSFSNKIICESAVNQLKDKQLGLEFIKNHSGTIVKLGMGKTAKILDVESYNEFVKGNYTKNISKRNKLMLEEIPDKMIERQLNDTRYISKFIISALSNIVRSESNDDGFNSKNVLPGNGKITSRLKQDWGMNDIWNELILPRFERMNKITDSAVFTAWNENNQKFLPIVPLEFSKGFQKKRIDHRHHALDALVIAASTREHINLLNNEHAKSDKRFDLNRKLRKFEKVAYNDPKTGKRIEKEVPTIFLKPWETFTVDAKNSLESIIVSFKQNLRVINRATNYSESYNDENGALRLGKDGNPLKEKIKQSKGDSWAIRKPMHKDFVYGKVHLQNVKLPKDKFITAIRKSLDVTFDLKRIETITDTGIQKILKNYLHSKENKVELAFSPEGIEDMNQHIERYNDGKKHQPIHKVRVFEIGSRFSLGESGNKKTKFVEAAKGTNLFFAVYQDDNKGKRNYETIPLNIVIERQKLGLHSVPTEDAKGGKLLFHLSPNDMVYVPTSEELEDNLASVNIKRLNTAQRKRIYKVEKASGVECYFIRQDIAYLIKNYDAKTKIGELESQNKLQTTMTDDRLKITDVCVKLNIDRLGSIAETFLGNQYGASKKT

SEQ ID NO: 323 - protein, 1233 aa, Mycoplasma canis
  Mycoplasma canis PG 14
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDEILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTASYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIATKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 324 - protein, 1233 aa, Mycoplasma canis; identical to SEQ ID NO: 323
  Mycoplasma canis PG 14

SEQ ID NO: 325 - protein, 1233 aa, Mycoplasma canis
  Mycoplasma canis UF31
MEKKRKVTLGFDLGIASIGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSIDKLNILLNLFNLPISEKKKKLTNANINDIVKKESTKSIMLSVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNELLNIENLKLKLKEFLLGAGNEFENHNSKTHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISTNEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNPDTSKTPKRLMFGIKSIMNNYEQVDISPFGINKKIFE

SEQ ID NO: 326 - protein, 1233 aa, Mycoplasma canis
  Mycoplasma canis UF33
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEENAKENKFKFQDLKILNVLINLLDNVGIKFEFKDRNDIIKNLELLDNLYLFLIYQKESNNKDSSIDLFIAKNKSLNIENLKLKLKEFLLGAGNEFENHNSKSHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGMAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDKFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 327 - protein, 1233 aa, Mycoplasma canis
  Mycoplasma canis UFG1
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMLSVEDIDMIKYEWAGKEPNVYGVGLSGLNIEESAKENKFKFQDLKILNVLINLLDNVGIKFEFKDRNDIIKNLELLDNLYLFLIYQKESNNKDSSIDLFIAKNKSLNIENLKLKLKEFLLGAGNEFENHNSKTHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFDDKYEKLIYKIFLWISQDFKDPYTGAKISANEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 328 - protein, 1233 aa, Mycoplasma canis
  Mycoplasma canis UFG4
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTIESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSIDKLNILLNLFNLPISEKKKKLTSANINDIVKKESTKSIMLSVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDAILPKLLDNNEGWNLEAIKNYDEEIKSQIEDNSFLMAKQDKKYLNDNFLKDAILPPNVKVTFQQAILIFNKIIQKFSKDFEIDKVVIELAREMTQDQENDALKGIAKAQKSKKSLVEERLEANNIDKSVFNEKYEKLIYKIFLWISQDFKDPYTGAKISANEIVDNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDDKKMFKVIAMNGAVTSFIRKNMSYDNKLRLKNRNDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKLSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 329 - protein, 1239 aa, Mycoplasma cynos
MEEKRKVTLGFDLGVASVGWAIVDSETNEVYKLGSRLFDIPDTNIDRRAKRGSRRLVRRRSYRNQKFYNLIKRTKTFGFLDKEAIEKEFVLLSIKYPNIIELKVKGLQEEVSKSEAVWILHDYLKNRGYFYDDKEEKDDLENPSIESMPSYKLYEFYKEYGYFKGALSSPTESEKNKDSDLEKAIFFNFSNKEWTKEINHFFKIQKNIFSEDFKAKFMEFFSFIRDISKGPGSENMPSQYSIFGKYGDDGMGGKYQHIWDKNIGKCSIFKDKVRAPKYLPSALFFNLLNELSNIRLYSVDKREKSVLWRLSSKDKINIILNILQIILFKNDGKISNLDINKIVKNESIKSIILNEIDLDLIKDMWFEKEPNVYGIGLSGLNIEENKKENRFKFQDLKIFSVFIDLLKKSNINIEFNNEKDIIHNLKLLDELYFFLITQKYSRDKYGSIKKFILNNKSFNIDNLDEKLNIFLSISDDEFDNHNSKTHSLSKEAIYFIFPKLLHNNEGWNLEAIKNYDIDVREEISKHSFGIKKQDKKYLDDAFLDDAILPPSVKVTIKQSILIFNKIIKKFSNKFQIDNVVIELAREMTQEKEMDAQKSLNRLKKSRKKIIEERLNANNIDSKMFRDKTGEISPNYIYKIYLWISQNFKDPYTGENISANDILKNNVEIDHIIPYSLCFDDSSSNKVLVFKHSNQSKGNFLPFDMISTFSENSVWNWKEYTQYVEKTFKTNLESILDKKERVKKADNLLTSSYDGYDKLGFLARNLNDTRYATILFRDQLINYSENHLIDSKKMFKVIAMNGGVTSFIRKNMSFDSGLKVKDRSIFSHHAYDAAIIALFSNKTKILYNLINPSLDGIISKRSEGYWVLEDRLTGEIRKLNYNDWQSIKNNVEVKKIAREIESHLSNLDNVVMFSRKSKRKTNKELYNETLYGIATRIDENGIKNYYKKEKFNILEDENIYLRLLNERENFIINRSNPEVIDAIIEIFETIDKNKIPARDVAKNIKYTDNKIKYNLYLKDYMRKLVDEFPDKFRKDFIEQMIAKKIFILFNPIKNTTRKIKSLRSINNNKIEDIRKKQVLEKFNTAKNEPRSFYESLNSLGAIIFKNNLNIYKKMSISSQIATFGDKNWKIDDINTYNKEKLNKYKEIYGIDETYDFYSFIFPGTILLDEKNKEFLYISSIQTLKDKIELKFLDRIEFEKKNVNSNLKPKIKREIISTKKLMSDYKIIKISPLGINKKIFE

SEQ ID NO: 330 - protein, 1269 aa, Mycoplasma gallisepticum
MNNSIKSKPEVTIGLDLGVGSVGWAIVDNETNIIHHLGSRLFSQAKTAEDRRSFRGARRLIRRRKYKLKRFINLIWKYNSYFGFKNKEDILNNYQEQQKLHNTVLNLKLEALNAKIDPKALSWILHDYLKNRGHFYEDNRDFNVYPTEELANYFGEYGYYKGIIDSKEDNDDKLEEGLTKYKFSNQHWLEEIKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVEREEKLEKEDHKWKLKGLKLNTNGKIQYNDLSSLAKFVHKLKQHLKLDFLLEDQYTTLDKINFLQSLFVYLGKHLRYSNRVDSANLKEFSDSNKLFERVLQEQKDDLFKLFEQTDKDDEKILAQTHSLSTKAMLLAITRMTNLDNDEDNQKNNDKGWNFEAIKNFDQKFIDITKKNNNLSLKQDKRYLDDRFINDAILSPGVKRILREATKVFNAILKQFSEEYDVTKVVIELARELSEEKELENTKNYEKLIKKNSDKISERLEALDIAEDKIEDILKSPTKSYKVLLWLQQDHIDPYSQKEIAFEDILTKTEKTEIDHIIPYSISFDDSSSNKLLVLAESNQAKSNQTPYEFITSGNAGIKWEDYEAYCRKFKDGDTSLLDSTQRSKKFAKMMKTDTSSKYDIGFLARNLNDTRYATIVFRDALKDYANNHLVEDKPMFKVVCINGGVTSFLRKNFDKSWYAKKDRDKNIHHAVDASIISIFSNETKTLFNQLTQFADYKLFKNTDGSWKKIDPKTGVVTEVTDENWKQIRVRNQVSEIAKVINKCIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMLRNKTAIIYNVEKKVVHRIKRLKILSSELKENKLSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLKDVIEIKNLIETEYKENDDSDPKKKKKANRFLMTLSTILNDYILLDAKDNFDILGLSKNRIDEILNSKLGLDKITK

SEQ ID NO: 331 - protein, 1224 aa, Mycoplasma gallisepticum
MNNSIKSKPEVTIGLDLGVGSVGWAIVDNETNIIHHLGSRLFSQAKTAEDRRSFRGARRLIRRRKYKLKRFINLIWKYNSYFGFKNKEDILNNYQEQQKLHNTVLNLKLEALNAKIDPKALSWILHDYLKNRGHFYEDNRDFNVYPTEELANYFGEYGYYKGIIDSKEDNDDKLEEGLTKYKFSNQHWLEEIKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVEREEKLEKEDHKWKLKGLKLNTNGKIQYNDLSSLAKFVHKLKQHLKLDFLLEDQYTTLDKINFLQSLFVYLGKHLRYSNRVDSANLKEFSDSNKLFERVLQEQKDDLFKLFEQTDKDDEKILAQTHSLSTKAMLLAITRMTNLDNDEDNQKNNDKGWNFEAIKNFDQKFIDITKKNNNLSLKQDKRYLDDRFINDAILSPGVKRILREATKVFNAILKQFSEEYDVTKVVIELARELSEEKELENTKNYEKLIKKNSDKISERLEALDIAEDKIEDILKSPTKSYKVLLWLQQDHIDPYSQKEIAFEDILTKTEKTEIDHIIPYSISFDDSSSNKLLVLAESNQAKSNQTPYEFITSGNAGIKWEDYEAYCRKFKDGDTSLLDSTQRSKKFAKMMKTDTSSKYDIGFLARNLNDTRYATIVFRDALKDYANNHLVEDKPMFKVVCINGGVTSFLRKNFDKSWYAKKDRDKNIHHAVDASIISIFSNETKTLFNQLTQFADYKLFKNTDGSWKKIDPKTGVVTEVTDENWKQIRVRNQVSEIAKVINKCIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMLRNKTAIIYNVEKKVVHRIKRLKILSSELKENKLSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLKDVIEIKNLIETEYKENDDSDPKKRRKQIGS

SEQ ID NO: 332 - protein, 1269 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKSEALNAKIDPKALSWILHDYLKNRGHFYEDNRDFNVYPTKELAKYFDKYGYYKGIIDSKEDNDNKLEEELTKYKFSNKHWLEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEINELSTIRSYSIYLTGWFINQEFKKAYLNKLLDLLIKTNGEKPIDARQFKKLREETIAESIGKETLKDVENEEKLEKEDHKWKLKGLKLNTNGKIQYNDLSSLAKFVHKLKQHLKLDFLLEDQYATLDKINFLQSLFVYLGKHLRYSNRVDSANLKEFSDSNKLFERILQKQKDGLFKLFEQTDKDDEKILAQTHSLSTKAMLLAITRMTNLDNDEDNQKNNDKGWNFEAIKNFDQKFIDITKKNNNLSLKQNKRYLDDRFINDAILSPGVKRILREATKVFNAILKQFSEEYDVTKVVIELARELSEEKELENTKNYKKLIKKNGDKISEGLKALGISEDEIKDILKSPTKSYKFLLWLQQDHIDPYSLKEIAFDDIFTKTEKFEIDHIIPYSISFDDSSSNKLLVLAESNQAKSNQTPYEFISSGNAGIKWEDYEAYCRKFKDGDSSLLDSTQRSKKFAKMMKTDTSSKYDIGFLARNLNDTRYATIVFRDALEDYANNHLVEDKPMFKVVCINGSVTSFLRKNFDDSSYAKKDRDKNIHHAVDASIISIFSNETKTLFNQLTQFADYKLFKNTDGSWKKIDPKTGVVTEVTDENWKQIRVRNQVSEIAKVIEKYIQDSNIERKARYSRKIENKTNISLFNDTVYSAKKVGYEDQIKRKNLKTLDIHESAKENKNSKVKRQFVYRKLVNVSLLNNDKLADLFAEKEDILMYRANPWVINLAEQIFNEYTENKKIKSQNVFEKYMLDLTKEFPEKFSEFLVKSMLRNKTAIIYDDKKNIVHRIKRLKMLSSELKENKLSNVIIRSKNQSGTKLSYQDTINSLALMIMRSIDPTAKKQYIRVPLNTLNLHLGDHDFDLHNMDAYLKKPKFVKYLKANEIGDEYKPWRVLTSGTLLIHKKDKKLMYISSFQNLNDVIEIKNLIETEYKENDDSDSKKKKKANRFLMTLSTILNDYILLDAKDNFDILGLSKNRIDEILNSKLGLDKIVK

SEQ ID NO: 333 - protein, 1269 aa, Mycoplasma gallisepticum; identical to SEQ ID NO: 332
  Mycoplasma gallisepticum str. F

SEQ ID NO: 334 - protein, 1270 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKLEALNAKIDPKALSWILHDYLKNRGHFYEDNRDFNVYPTEELANYFDEFGYYKGIIDSKNDDDDKLEEGLTKYKFSNQHWLEEVKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVESEEKLEKDDHKWKLKGLKLNTNGKIQYNDLSSLAKFVHKLKQHLKLDFLLEDQYTPLDKINFLQSLYVYLGKHLRYSNRVDSANLKEFSDSSRLFERVLQEQKDGLFKLFEQTDKDDEKILTQTHSLSTKAMLLAITRMTNLDNDEDNQKNNDKGWNFEAIKNFDQKFIDITKTNNNLSLKQDKRYLDDQFINDAILSPGVKRILREATKVFNAILKQFSEEYDVTKVVIELARELSEEKELENTKNYKKLIKKNGDKISEGLKALGIAEDKIEEILKSPTKSYKVLLWLQQDHIDPYSQKEIAFDDILTKTEKTEIDHIIPYSISFDDSSSNKLLVLAESNQAKSNQTPYEFINSGKAEITWEVYEAYCHKFKNGDSSLLDSTQRSKKFAKMMKTDTSSKYDIGFLARNLNDTRYATIVFRDALKDYANNHLVEDKPMFKVVCINGGVTSFLRKNFDPKSWYAKKDRDKNIHHAVDASIISIFSNETKTLFNQLTKFADYKLFKNTDGSWKKIDPKTGVVSEVTDENWKQIRVRNQVSEIAKVIDKYIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMIRNKTAIIYNVEKDVVHRIKRLKILSSELKENKWSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLNDLIEIKNLIETEYKENVDSDPKKKKKASQILRSLSVILNDYILLDAKYNFDILGLSKNKIDEILNSKLDLDKIAK

SEQ ID NO: 335 - protein, 1236 aa, Mycoplasma mobile
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 336 - protein, 1265 aa, Mycoplasma ovipneumoniae
  Mycoplasma ovipneumoniae SC01
MHNKKNITIGFDLGIASIGWAIIDSTTSKILDWGTRTFEERKTANERRAFRSTRRNIRRKAYRNQRFINLILKYKDLFELKNISDIQRANKKDTENYEKIISFFTEIYKKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFTSVRDYAKGPGSEHSASEYGIFQKDEKGKVFKKYDNIWDKTIGKCSFFVEENRSPVNYPSYEIFNLLNQLINLSTDLKTTNKKIWQLSSNDRNELLDELLKVKEKAKIISISLKKNEIKKIILKDFGFEKSDIDDQDTIEGRKIIKEEPTTKLEVTKHLLATIYSHSSDSNWININNILEFLPYLDAICIILDREKSRGQDEVLKKLTEKNIFEVLKIDREKQLDFVKSIFSNTKFNFKKIGNFSLKAIREFLPKMFEQNKNSEYLKWKDEEIRRKWEEQKSKLGKTDKKTKYLNPRIFQDEIISPGTKNTFEQAVLVLNQIIKKYSKENIIDAIIIESPREKNDKKTIEEIKKRNKKGKGKTLEKLFQILNLENKGYKLSDLETKPAKLLDRLRFYHQQDGIDLYTLDKINIDQLINGSQKYEIEHIIPYSMSYDNSQANKILTEKAENLKKGKLIASEYIKRNGDEFYNKYYEKAKELFINKYKKNKKLDSYVDLDEDSAKNRFRFLTLQDYDEFQVEFLARNLNDTRYSTKLFYHALVEHFENNEFFTYIDENSSKHKVKISTIKGHVTKYFRAKPVQKNNGPNENLNNNKPEKIEKNRENNEHHAVDAAIVAIIGNKNPQIANLLTLADNKTDKKFLLHDENYKENIETGELVKIPKFEVDKLAKVEDLKKIIQEKYEEAKKHTAIKFSRKTRTILNGGLSDETLYGFKYDEKEDKYFKIIKKKLVTSKNEELKKYFENPFGKKADGKSEYTVLMAQSHLSEFNKLKEIFEKYNGFSNKTGNAFVEYMNDLALKEPTLKAEIESAKSVEKLLYYNFKPSDQFTYHDNINNKSFKRFYKNIRIIEYKSIPIKFKILSKHDGGKSFKDTLFSLYSLVYKVYENGKESYKSIPVTSQMRNFGIDEFDFLDENLYNKEKLDIYKSDFAKPIPVNCKPVFVLKKGSILKKKSLDIDDFKETKETEEGNYYFISTISKRFNRDTAYGLKPLKLSVVKPVAEPSTNPIFKEYIPIHLDELGNEYPVKIKEHTDDEKLMCTIK

SEQ ID NO: 337 - protein, 1314 aa, Mycoplasma synoviae
MLRLYCANNLVLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 338 - protein, 1304 aa, Mycoplasma synoviae
  Mycoplasma synoviae 53
MLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 339 - protein, 1401 aa, Myroides injenensis
  Myroides injenensis M09-0166
MKRILGLDLGTTSIGWAYVHEAENVNETSSIQKVGVRVNPLTTEEQTNFEKGKPITTNASRTLARSARRNLQRYKLRRDNLIQILKENNWINNTTSLTETGNHSTFETYELRNKAASEKLTLDQLSRVLLMLNKKRGYKSSRKVNSKEEGQLIDGMEVAKKLYHEQLTPGQLSLQLMNQGVKKLPDYYRSDLNQELESIWNFQQQFYPNILTDKFKEEINGKGLTSTSSAFWNIYNFNTAENKGSRDEKKKQALQWRSEALSKQLSKEIVAYIIADLNGQIYNSSGYLGAISDRSKELYFNNLTVGQYLFKQLKSNPHTSLKNQVFYRQDYLNEFEKIWETQSKFYPKELTAALKREIRDVIIFYQRKLKSQKGLISFCEFEQKQKTINGKTKTIGHRVIPKSSPLFQEFKIWQQLHNVVLRNKKTNEIVSLADEQKVHLFEELNLKGKLKSNQVLKLIENKPKDWELNYTELEGNNTNKALYNAYLDILDIEGYDVRNELKVKLNKDDIELSDLDVNASEIKEMIFSVFKHLGINTEILEFDATLEDKVFEKQASYQLWHLLYSYEEDNSPTGLDRLYNLLHKKFGFKLNHAKLIGNVLFQDDYGSLSSKAIKNIFPYITENNYYTACELAGYKHSKHSLTKEENETRELKNRLTILPKNSLRNPVVEKIINQMINVVNTLIDEENNILIAQGKEPNFQFDEIRIELARELKKNAKEREELTKSINKSKTDHEKIIKILQKEDGIKNPTRNDIVRFKLYSELKNNGYKDLYTNEYIERKDIFTKEYDIEHIIPQSKLFDDSFSNKTLVRRNVNLKKGNQTAYDFILCEYGQEKANEFETRITNLYNLGKDEGISKSKFKKLLMQESEIGNGFIERDLRETQYIAKKAKSLLLEITRNVISTSGSITDRLREDWGLINVMKELNLQKYRDAGLTEFVKMKDGNKKEVIIDWTKRNDHRHHAMDALTIAFTKHNHIQYLNHLNARKNVNNELHNNIIAIEKLETTLVSDERGNKKRIFKEPIANFRTIAKSHLEAILVSHKAKNKVVTKNINKISGKKISQQTLTPRGQLHKETIYGKIRQYVSKQEKVGPKFTIEVIEQVSNPTYRNLLLKRLEENNNDPKKAFGGKNSLNKNPIYINLEKNIKVPEVLKLVWLEDNYTIRKEISPDLKIDKVIDQGVKQILQNRLAQYKGDSKLAFSNLDANPIWLNEDKGIAIKRVTISGIATAQPLHRKKDHLGQPILDHNGQEIPVDFISTGNNHHVAIYEDENGKLQESVVSHFEAVERVNQKLPIIDKTFNQHLGWKFLFTMKQNELFLFPSDDFNPNEIDLFDKQNYTVISKHLFRIQKLSTKDYSFRHHLETNVEEIKDLKTITWRREGLNGIQNIIKVRTNHLGEIIHIGEY

SEQ ID NO: 340 - protein, 1466 aa, Myroides odoratus
  Myroides odoratus DSM 2801
MKNILGLDLGTNSIGWALVKEDFENKQGEILGLGSRIIPMSQDILGEFGRGNSISQTADRTGYRGVRRLRERHLLRRERLHRVLNILGFLPNHYAKEIDFTKRLGKFINHAEPKLSFDKEFIFKDSFNEMLKDFQQNQPGFIINKHGEEALVPYDWTIYYLRKKALTQKIDKEELAWILLNFNQKRGYYQLRGEEEEENTNKLVEFYSLKIIDVIADNEVNKKGEVWYSLHLENGWIYRRSSKISLVDWKDKVRDFIVTTDVNDDGSEKLDKDGVVKRSFRAPSADDWTLLKKKTEQDIDNSNKTVGAYIYENLLLNPKQKIKGKLVRTIERKFYKDELKQILEKQKEFHQELQNEQLLQDCVRELYKYNEQHQQMLESKDFVHLFLNDIIFYQRPLRSQKSLISNCTLEKRVSRDGVVFPIKVISKSNPYYQEFRLLQWLQNLAIYRKDDDVNVTQEFLNSIESWENLLQFLNAKKEIKQEQLIKFLLEQKGLKGNSLKTAILTYRWNYVTDKVYPMNETRSLIQDKLKKVENVATDFLSFDNEMALWHIIYSVNDKIEYEKALAKFASKHNLDEISFVESFKKFPPFKSDYGSFSEKAIKKLLPLMRFGSVWNKNNIVPSVLDRIDKILTGEYDEKIKIRVREKAEQFQLNQIEDFQNLPLWLAQYVVYDRHSEAEIAGKWNSVKDLENYLKEFKQHSLRNPIVEQIITETLRVVKDIWQQYGNGVQNFFDEIHIELGREMKNTADERKRITNSVTENENTNLRIKALLVELKEDTNIENVRPHSPMQQEILKIYEEGVLNAVENIDEDILKISKTAQPSKSELIRYKLWLEQKYQSPYTGEMIPLSRLFTSDYEIEHVIPQSRYFDDSLSNKVICEAAVNKRKDNQLGLEFIKNHHSEKIELGNGRTAQVLEVEAYESFVKKNYDKNRGKRNKLLLEDVPEKMIERQLNDTRYISKFVTHLLSNIVRKDEVNSKDDGINSKNIIPGNGKITSQLKQDWGLNDVWNELILPRFERMNNLTNSTDFTSTNTNGKIIPTVPLEYSKGFSKKRIDHRHHALDALVIALATRDHVNLLNNESALPKKDRTKEEQKSFRFDLQVNLRNKEKYFNVKEGREKEKFTTFKKPWNTLTQDTRDALENMVVSFKQNLRVINKATNYYESYTDENGNLRLDKYGNPKKELISQKGTNWAIRKSLHKETVSGQIHLDRVKVTKGKIVTATRKSLDSSFNEKSIESITDTGIQKILRNYLKAKDNKPDVAFSPEGIEELNKSISVYNEGKNHQPIIKVRIFEQGSKFPVGETGNKIAKFVEAAKGTNLFFGIYQDKTGKRSYDTIPLNLVIERLKQGLSPVPETNEKGHQLLFHLSPNDLVYVPTIDDNEQLDSNRVYKFTDSSDTTCNFIPSNISAIIFNINSKEQEKRGINYPIQNELGVGSPQSKNQKSFDGFMIKEVCIKLKVDRLGNISKT

SEQ ID NO: 341 - protein, 1077 aa, Neisseria bacilliformis
  Neisseria bacilliformis ATCC BAA-1200
MQQKPQRYILGLDLGIASVGWACVWADENEHPTGLLDCGVRTFERAEVPKTGDSLALARRQARSVRRLIRRRAHRLLRLRRLLKREGVLLSADFNENGLVRGLPIDAWALRVAGLDRKLSNKEWAAVLLHLVKHRGYLSQRKNETQSKDKELGRLLAGVNGNREALQNRSDEYRTAAELAVKKFAAENNGSLRNKGGDYSHTFDRKDLQRELHLLFERQRALDNPFTSSEMEAAVDELLMKQRSALQGEAVLKMLGRCTFEPSEYKAAKNTYSAERFVWLTKLNNLRIQYNGEERALSEAERRLLLDEPYQKAKLTYKQVRTILELPESAVFKGLRYGHGEDGLKAESGTLMEMKAYHAVRKALKDAGLEGEWENRIRNPELLDAIGTAFSLYKTDEDIRANLAAFRLSENVLEALLAGLNFDKFVHLSLKALAKILPLMEQGMRYDEACKEAYGDHYGAKEQEDHRLLPPFVADDIRNPVVFRTLTQARKIVNEIVRRYGSPLRVHIETGREVGKSFSDRKEIEKRQEENRKERERAAAHFKELFPNFAGEPKAQDILKLRLYEQQHGKCLYSGKEIDLRRLPEKGYVEIDHALPFSRTWDDSFNNKVLVLGKENQDKRNRTPYEYLDGKGNSGAWRAFAERVSGCRFPYAKKQRLLTQKLDEKTEQGFLERNLNDTRYVARFLCQFIEEKMHLEGAGKKRVFASNGQITALLRGFWGLKKVREENDRHHALDAVVVACSSVSMQQKITRHFRYREELEHIDRETGEVIHGFPQPWEFFRQEVMTRVFSDDPVSELAEKLDSRPEAVHEFVTPLFVSRAPHRKVTGQGHLETIRSAKRLDEKISVVKLPLTQLKTKDIERIVGYPNREPALYDALAARLAAFKDDPAKAFSEPFYKTGKDGKCGVLVKAVRVENVQKSGLLVRKDESGKMQGVADNATMVRVDVFGKNGKNYLVPVYAWQVEKGELPNRAVVAYADEEDWDEMDDSFEFKFSLYPNDLVEVVTKKDKFFGYYSGFNRATGAINIKEHDLSKSKVKNGVYEGIGVKTAQSFQKYQVDTLGKTIRLCKPEKRMGFKKK

SEQ ID NO: 342 - protein, 1082 aa, Neisseria cinerea
  Neisseria cinerea ATCC 14685
MAAFKPNPMNYILGLDIGIASVGWAIVEIDEEENPIRLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNTHALQTGDFRTPAELALNKFEKESGHIRNQRGDYSHTFNRKDLQAELNLLFEKQKEFGNPHVSDGLKEGIETLLMTQRPALSGDAVQKMLGHCTFEPTEPKAAKNTYTAERFVWLTKLNNLRILEQGSERPLTDTERATLMDEPYRKSKLTYAQARKLLDLDDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGNRYDEACTEIYGDHYGKKNTEEKIYLPPIPADEIRNPVVLRALSQARKVINGVVRRYGSPARIHIETAREVGKSFKDRKEIEKRQEENRKDREKSAAKFREYFPNFVGEPKSKDILKLRLYEQQHGKCLYSGKEINLGRLNEKGYVEIDHALPFSRTWDDSFNNKVLALGSENQNKGNQTPYEYFNGKDNSREWQEFKARVETSRFPRSKKQRILLQKFDEDGFKERNLNDTRYINRFLCQFVADHMLLTGKGKRRVFASNGQITNLLRGFWGLRKVRAENDRHHALDAVVVACSTIAMQQKITRFVRYKEMNAFDGKTIDKETGEVLHQKAHFPQPWEFFAQEVMIRVFGKPDGKPEFEEADTPEKLRTLLAEKLSSRPEAVHKYVTPLFISRAPNRKMSGQGHMETVKSAKRLDEGISVLRVPLTQLKLKDLEKMVNREREPKLYEALKARLEAHKDDPAKAFAEPFYKYDKAGNRTQQVKAVRVEQVQKTGVWVHNHNGIADNATIVRVDVFEKGGKYYLVPIYSWQVAKGILPDRAVVQGKDEEDWTVMDDSFEFKFVLYANDLIKLTAKKNEFLGYFVSLNRATGAIDIRTHDTDSTKGKNGIFQSVGVKTALSFQKYQIDELGKEIRPCRLKKRPPVR

SEQ ID NO: 343 - protein, 1081 aa, Neisseria flavescens
  Neisseria flavescens SK114
MTAFKPNPINYILGLDIGIASVGWAMVEIDEEENPIRLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELAVNKFEKESGHIRNQRGDYSHTFSRKDLQAELVLLFEKQKEFGNPHISDGLKEGIETLLMAQRPALSGDAVQKMLGYCTFEPTEPKAAKNTYTAERFIWLTKLNNLRILEQGSERPLTDTERATLIDMPYKNKLTYAKARELLGLDDTAFFKGLRYGKDNAESATLMEMKAYHAIRRALEKEGLKDKKSPLSLSPELQDEIGTAFSLFKTDEDITGRLKGCLQPEILDALLKHINFDKFVQISLKALRRIVPLMEQGKRYDEACAETYGDHYGEKNSEEMLYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKAIDIRRLNGKGYVEIDHALPFSRTWDDSFNNKVLVLGSENQNKGNRTPYEYLNGKDNSREWLEFKARVETSRFPHSKKQRVLLQKFDEKGFKERNLNDTRYVNRFLCQFVADHMQLTGKGKRRVFASNGQITNLLRGFWGLHKVRAENDRHHALDAVVVACSTVAMQQKITCFVRYKEMNAFDGKTVDKETGEVLHQKTHFPQPWEFFAQEVMIRVFGKPDGKPEFEEADTPEKLRALLAEKLSSRPEAVHEYVTPLFVSRAPNRKMSGAHKDTLRSAKRFVKHNEKISVKRVWLTEIKLADLENMVNYKNGREIELYEALKARLGAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLMQKYQIDELGKEIRPCRLKKRPPVR

SEQ ID NO: 344 - protein, 1082 aa, Neisseria lactamica
MAAFKPNPMNYILGLDIGIASVGWAMVEIDKEENPIRLIDLGVRVFERAEVPKTGDSLAMARRLARSVRRLTRRRAHRLLRARRLLKREGVLQDADFDENGLVKSLPNTPWQLRAAALDRKLTCLEWSAVLLHLIKHRGYLSQRKNEGETADKELGALLKGVADNAHALQTGDFRTPAELALNKFEKESGHIRNQRGDYSHTFSRKDLQAELNLLFEKQKEFSNPHVSDSLKEGIETLLMAQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEAPTLMEMKAYHAISRALEKEGLKDKKSPLNLSTELQDEIGTAFSLFKTDKDITGRLKDRVQPEILEALLKHISFDKFVQISLKALRRIVPLMEQGKRYDEACAEIYGDHYCKKNAEEKIYLPPIPADEIRNPVVLRALSQARKVINCVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKGLEKMVNREREPKLYDALKAQLETHKDNPAKAFAEPFYKYDKAGNRTQQVKAVRIEQVQKTGVWVRNHNGIADNATMVRVDVFEKGGKYYLVPIYSWQVAKGILPDRAVVAFKDEEDWTVMDDSFEFRFVLYANDLIKLTAKKNEFLGYFVSLNRATGAIDIRTHDTDSTKGKNGIFQSVGVKTALSFQKNQIDELGKEIRPCRLKKRPPVR

SEQ ID NO: 345 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELNLLFEKQKEFGNPHISDGLKEGIETLLMTQRPALSGDAVQKMLGHCTFEPAEPKAAKNTYTAERFIWLTKLNNLRILEQGSERPLTDTERTTLIDEPYRKSKLTYAQARKLLELDNTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEKIDLPPIPADEIRNPVVLRALSQARKVINGVVRRYGSPARIHIETAREVGKSFKDRKEIEKRQEENRKDREKAATKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHMLLTGKGKRRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 346 - protein, 1082 aa, Neisseria meningitidis
  Neisseria meningitidis 2007056
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGEEIRPCRLKKRPPVR

SEQ ID NO: 347 - protein, 1082 aa, Neisseria meningitidis
  Neisseria meningitidis 63049
MAAFKPNPINYILGLDIGIASVGWAMVEIDEEENPIRLIDLSVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFVWLTKLNNLRILEQGSERPLTDTERATLMDEPYRKSKLTYAQARKLLGLEDTAFFKGLRYGKDNAEASTLMEMKAYHAISRALEKEGLKDKKSPLRLSPELQDEIGTAFSLFKTDEDITGRLKDRVQPEILEALLKHISFDKFVQISLKALRRIVPLMEQGKRYDEACAEIYGDHYGKKNAEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 348 - protein, 1082 aa, Neisseria meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 349 - protein, 1082 aa, Neisseria meningitidis
  Neisseria meningitidis 92045
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKECGHIRNQRGDYSHTFSRKDLQAELNLLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGGKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 350 - protein, 1081 aa, Neisseria meningitidis
  Neisseria meningitidis 93003
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEEIYLPPITADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKENSREWQEFKARVETSRFPRSKKQRILLQKFDEDGFKERNLNDTRYVNRFLCQFVADRMRLTGKGKKRVFASNGQITNLLRGFWGLHKVRAENDRHHALDAVVVACSTIAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKDLEKMVNRAREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 351 - protein, 1081 aa, Neisseria meningitidis
  Neisseria meningitidis 93004
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAKLALNKFEKESGHIRNQRGDYSHTFSRKDLQAELNLLFEKQKEFGNPHISDGLKEGIETLLMTQRPALSGDAVQKMLGHCTFEPTEPKAAKNTYTAERFVWLTKLNNLRILEQGSEQPLTDTQRAKLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYNEACAEIYGDHYGKKNTEEKIYLPPIPADEIRNPVVLRALSQARKVINGVVRRYGSPARIHIETAREVGKSFKDRKEIEKRQEENRKDREKAAAKFQEYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 352 - protein, 1082 aa, Neisseria meningitidis
  Neisseria meningitidis 96023
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSSDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLYQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 353 - protein, 1081 aa, Neisseria meningitidis
  Neisseria meningitidis 98008
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRSAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEGWTVIDESFRFKFVLYSNDLIKVQLKKDSFLGYFSGLDRATGAISLREHDLEKSKGKDGMHRIGVKTALSFQKYQIDEMGKEIRLCRLKKRPPVR

SEQ ID NO: 354 - protein, 1082 aa, Neisseria meningitidis
MAAFKPNPINYILGLDIGIASVGWAMVEIDEEENPIRLIDLGVRVFERAEVPKTGDSLAMVRRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHISGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 355 - protein, 1082 aa, Neisseria meningitidis
  Neisseria meningitidis alpha275
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 356 - protein, 1082 aa, Neisseria meningitidis
  Neisseria meningitidis ATCC 13091
MAAFKPNPINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTLWQLRAAALDRKLTPLEWSAVLLHLIKHRGYLSQRKNEGETADKELGALLKGVAGNAHALQTGDFRTPAELALNKFEKESGHIRNQRGDYSHTFSRKDLQAELNLLFEKQKEFGNPHISDGLKEGIETLLMTQRPALSGDAVQKMLGHCTFEPTEPKAAKNTYTTERFIWLTKLNNLRILEQGSERPLTDTERATLMDEPYRKSKLTYAQARKLLELDDIAFFKGLRYGKDNAEASTLMEMKAYHAISRALEKEGLKDKKSPLNLSPELQDEIGTAFSLFKTDEDITGRLKDRIQPEILEALLKHINFDKFVQISLKALRRIVPLMEQGKRYDEACAEIYGDHYGKKNTEEKIDLPPIPADEIHNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLTEKLSSRPEAVHEYVTPLFVSRAPNRKMSGQGHMETVKSAKRLDEGISVLRVPLTQLKLKDLEKMVNREREPKLYEALKARLEAHKDDPAKAFAEPFYKYDKAGNRTQQVKAMRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 357 - protein, 1081 aa, Neisseria meningitidis
  Neisseria meningitidis N1568
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKECGHIRNQRGDYSHTFSRKDLQAELNLLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLSLEDTAFFKGLRYGKDNAEASTLMEMKAYHTISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 358 - protein, 1081 aa, Neisseria meningitidis
  Neisseria meningitidis NM140
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRSAALDRKLTPLEWSAVLLHLIKHRGYLSQRKNEGETADKELGALLKGVADNAHALQTGDFRTPAELALNKFEKESGHIRNRRGDYSHTFSRKDLQAELDLLFEKQKEFGNPHISDDLKEGIETLLMTQRPALSGDAVQKMLGHCTFEPTEPKAAKNTYTAERFVWLTKLNNLRILEQGSERPLTDTERATLMDEPYRKSKLTYAQARKLLELDDTAFFKGLRYGKDNAEASTLMEMKAYHAISRALEKEGLKDKKSPLNLSPELQDEIGTAFSLFKTDEDITGRLKDRVQPEILEVLLKHISFDKFVQISLKALRRIVPLMEQGKRYDEACAEIYGDHDGKKNTEEKIYLPPIPADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHMLLTGKGKRRVFASNGQITNLLRGFWGLRKVRAENNRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEGWTVIDESFRFKFVLYSNDLIKVQLKKDSFLGYFSGLDRATGAISLREHDLEKSKGKDGMHRIGVKTALSFQKYQIDEMGKEIRLCRLKKRPPVR

SEQ ID NO: 359 - protein, 1082 aa, Neisseria meningitidis
  Neisseria meningitidis NM220
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 360 - protein, 1082 aa, Neisseria meningitidis
  Neisseria meningitidis NM233
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADKIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 361 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSSDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 362 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 363 - protein, 1089 aa, Neisseria sp.
  Neisseria sp. oral taxon 014 str. F0314
MTAFKPNPLNYILGLDIGIASVGWAMVEIDDKENPVRLIDLGVRVFERAEMPKTGDSLAAARRLARSVRRLTRRRAHRLLRARRLLKHEGVLKPEDFDENGLVKPLPYIPKQPRNTPWQLRAAALDRKLTPLEWAAVLLHLVKHRGYLSQRKNEGETDDKELGALLKGVADNTHALQAGNFRTPAELALNKFEKESGHIRNQRGDYSHTFSRKDLQAELVLLFEKQKEFGNPYVSDDLKNGIENLLMTQRPALSGDAIQKMLGHCTFEPAEPKAAKNTYTAERFIWLTKLNNLRILNQGNERPLTDAERTTLMDEPYKKSKLTYAQARKLLDLDDTAFFKGLRYGKDNAESATLMEMKAYHAISRALEKEGLKDKKSPLSLSPELQDEIGTAFSLFKTDEEITGRLKGCLQPEILDALLKHISFDKFVQISLKALRRIVPLMEQGKRYDEACAEIYGDHHGRRNSEETLYLPPIPADEIRNPVVLRALSQARKVINGVGRRYGSPARIHIETAREVGKSFKDRKEIEKRQEENRKDREKAAAEFQEYFPNFVGEPKSKDILKLRLYRQQNCKCLYSGKEINLGRLNEKGYVEIDHALPFSRTWDDSFNNKVLVLGSENQNKGNRTPYEYLNGKDNSREWQEFKARVETSRFPHSKKQRILLQKFDEEGFKERNLNDTRYVNRFLCKFVADHMQLTGKGKRRVFASNGQITNLLRGFWGLRKVRAENDRHHALDAVVVACSTVAMQQRITRFVRYKEMNAFDGKTVDKETGEVLHQKTHFPQPWEFFAQEVMIRVFGKPDGKPELEEADTPEKLRALLAEKLSSRPEAVHEYVAPLFVSRAPNRKMSGQGHMETIKSPKRLDEGISVVRVPLTQLKLKDLEKMVNREREPKLYEALKARLEAHKDDPAKAFAEPFYKQDKAGNRTQQVKAVRIEQVQKTGVWVRNQNGIADNATMVRVDVFEKGGKYYLVPIYSWQVAKGILPDKAIIAFKDEEEWQLIDDSFNFKFPLHPNDLVEVITKKARIFGYFASCHRGTGNINIRIHDLDNKVGKNGILEGIGVKTALSFQKYQIDELGKEIRPCRLKKRPPVR

SEQ ID NO: 364 - protein, 1097 aa, Neisseria wadsworthii
  Neisseria wadsworthii 9715
MKKQPQRYILGLDLGIASVGWALILVDGAENPVGLLDCGVRTFERAEVPKTGDSLALARRQARSVRRLIRRRAHRLLRLRRLLKREGILSAADFNSDGLPNLPIDAWQLRVAGLERKLTNQEWAAVLLHLVKHRGYLSQRKSETQTENKELGRLLAGVAENSKLLSESSEQYRTPAELAVKLFAEQSGHLRNKGGEYTHTFNRLDLQKELHLLFERQYALGNPFASAELQSKVDELLMTQRSALQGEAVLKMLGKCTFEPSEYKAAKNTYSAERFIWLTKLNNLRILYNGEERALDEGDRKKLLDEPYKKAKLTYKQVRSILNLPESAVFKGLRYGKDSDGLKAENGTLMEMKAYHKIRTILDKAGLKGEWENRIRNPEILDKIGTAFSLYKTDEDIQAALADLRLPENVLDALLAGLNFDKFIQLSLKALRNILPLMERGIRYDEACKEVYGDHRALAESKNQVLLPPIPADEIRNPVVLRTLTQARKVINAIIRRYGSPQRVHIETARELGKSKQERDKIDRKNKENQNDRNRLASDIRKHFNFEPTPKDILKLRLYEQQHGKCLYSDLREEKGECLYTGNVIELHRLFEDGYVEIDHALPLSRTWDNSLNNKVLVLKSSNQNKGNKTPYEWLDGANNSRRWREFQARVQGCHFPYVKKQRIQTAKLDSKAEQGFLERNLNDTRYISKFMCQFITANLRLAETSNALMEEVAGENPYWKERKRQRVFAPSGSIIALLRGLWGLKKVREDNDRHHALDAIVVACSTVSMQQKITKAMQRRETLETVDSETGEVKTRIPQPWDFFRQEVMIRVFSDSPREELAEKLNSRPEALHDFVSPLFVSRAPNRKMTGQGHLETVKSAKRLSENISVVRKPLTALKLKDIENIVGYPDREPALYQALRERLLAHKDDPVKAFADKPFYKPAKDGGQGSLVKAVRIIENTKHGLKIRNGITDTNGDMVRTDVYQKTDKKGKRQYFIVPVYAWQVEKNELPTVDCKGYEIDDNYEFCFSLYKYDLIEIQNPNDINQELRAYYINCDSSDGRFWLAYHDKSAKEQQFRISTQNQPIIKKYQVDTLGKEIRLCKAEKRTALNGKKKK

SEQ ID NO: 365 - protein, 1426 aa, Niabella soli
  Niabella soli DSM 19437
MPRKNILGLDLGTTSIGFAKIIEDDDYQCSSVELIGVRVNPLTTDEQTNFEKGKPVSVNADRTLKRGMRRNLDRYQLRRDYLIEILRTHHIITADTKLAEDGKNTTHTTYALRALAATAEIPLEAFVRVLLAINKKRGYKSSRKAKNEDEGQLIDGMAIARRLYEESLTPGQFSYQLLKEGKKYLPDFYRSDLNTELNKVWNFQKQFYPEILTDEFKRHLEGKGQRATAVAFWGQHGFSMAENKGSREEKKLHAYKWRSEAAHKQLTKEEVAFVITEINNDLNKSSGYLGAISDRSKELFFNKQTVGQYLHQQLKENPHTRLKGQVFYRQDYLDEFETIWEMQAKFYSALTLELKEEVRDVVIFYQRKLKSQMGLISLCEFESKEIEIEKNGEKAKKRIGLRVAPKSSPLFQEFKIWQVLNNLEFRNKKTKEVFVPEMAAKQQLFDELNIKGNLLASEAIKILGYKTKDWEANYHTLEGNRTNKSLYDAWLKILELEGYDENLLKLSGSDDIDVSKIEKPALEIRQMVLAVFEVLGISGAILDFDAEADGKAFEQQPAYQLWHLLYSAEDDGKKYSQEDIFTYGHDNIGLKKKLCEKFGFRPEHTKILVNVVFSDDYGNLSSKAMRRIYPFIKELTYDKACAEAGYRHSAASLTKEEIAARPLQNRLDLLKKNELRSPVVEKILNQMVNVVNTLVDDENQNRKARGLSEDFHFDEIRIELARELKKNAKERAEMTTNINTAKQSHEKIIRILQTEFGVPNPSRNDIVRYKLYEELKNNGYKDLYTNTYISRDILFSKQIDVDHIIPQMSLFDDSFSNKTVVFRKDNQDKGNKTAYDYILGKYGEQALEEYISRITSLFELGKKNKEEGIGKAKFQKLQKRLVDIGDGFIERDLRESQYIAKKANNMLYAICRSVVSTSGEITARLREDWDLVNVMQEINLPKFRALGLTEMVEKKDGAQKERITDWTKRNDHRHHAMDALAIAFTRHSHIQYLNHLNARKDEANKWHPVVSKIEEKETVLIYDDLGNRKRKFKAPMPNFREVVKEHLENVLISHKAKNKVVTKNKNKIKTVRGEKVKTELTPRGQLHKETIYGRYRYYESKEEKIGPKFDAEMIGMVTNPQYKKLLLERLAANGNDPKKAFWGKNALNKNPLYVDEARQELLPEKILLRWLNDDYSIRKDVTPENLKDIKTIEKILDKGVKKILLKRLADFGNDPKKAFSDLDKNPIWQNEAKRIAIKRVTISGIKNAAPLHHKKDHLGNDILDEKGKQIPSSFVSTGNNHHVAIYRDAEGNLQERVVSLFDAVQLVNGGEPVIDKEYNKGIGWQFLFTMKQNEMFVFPDEKTGFNPREVDLLSSGNRKLISPNLFRVQKLASKNYFFRHHLETSVEEKKELKNIAYKPQLGLNALSNIVKVRINHIGEIVSVGEY

SEQ ID NO: 366 - protein, 1132 aa, Nitratifractor salsuginis
MKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 367 - protein, 1166 aa, Nitrobacter hamburgensis
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 368 - protein, 1044 aa, Nitrosomonas sp.
  Nitrosomonas sp. AL212
MLHKMRYRLALDLGSTSLGWAMVRLNANQQPCAVIKAGVRIFSNGRNPKDGSSLAVTRREARSMRRRRDRLLKRKARMMRTLIEYGFFPANETQRKALENLNPYALRAKGLDEALTPSEFARALFHINQRRGFKSNRKTDKKDSDSGALKTAIKQLHSVLDPQGNDGKPRTVGELLYKRFTDLSKLPKDRTVRARYRQDKIVKDDGKTKIDKYYDLYIDRAMIEQEFDALWKKQSELNPILFTENARADLKDVLLYQRSLKPVKPGRCTFMSEEERAPLALPSTQRFRMYQEVNNLRILREGLKEESLTLQQRDDLINALEKNNRRTFTQIKKLLGVGGSVQFNFEDPKREELKGNTTSAILGKSEHFGEAWFAFNEAKQDAIVLQLIKEENEAKLVRWLQDETGIDEKRAEVIANAGLPEGYGSLCIEALARILPELRRDVVTYDKAVQAAGFEHHSKLNRNEEIPDITFKIESIDRNSGEIKQFHLHKELPYYGEYLQRHVGFGSGKPEDSIEKRYGKIANPTVHIGLNQVRVVVNALIKRYGHPSEIIVEVARDLKQSKDRRDEENKRQAENQKRNERLRKDIADILGISEERVRRDDIEKMILWEELSFDPADRRCPYSGVQVSTVMLLSDEVEVEHILPFSQTLDDSLNNKTVALRQANRIKGNRTPWEAFGTSNISGFDYSGILTRAELMPKAKRYRFAEDGYQRWLKDDAGFLARALNDTRHLSKIAREYMSLICPNTRVIPGQMTAMLRRNFGLNDVLGLNGEKNRNDHRHHAVDACVIAVTDQGLLQRFAAASASARERQLNRLVENMPLPWESYREHVRRAIDGIWVSHRPDHSHEGAMHNDTAYGLRGNGRVSFHKMVEGKREYIEDNLKVIEITDTKAIDRHGLLPTGKPRPYKGYKGDSNYCIEIVRNEKGRWEGEIISTFDAYQLVRKYGIVQLRYPVLSVSGKPLVMRLIRNDFVRLEHEGITRTLRVCKMREDGQVALADVTEANVDARTRTKEICYVFKTGGSLQKAKARRITISPIGELRDPGFKE

SEQ ID NO: 369 - protein, 1498 aa, Odoribacter laneus
  Odoribacter laneus YIT 12061
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 370 - protein, 1389 aa, Oenococcus kitaharae
  Oenococcus kitaharae DSM 17330
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 371 - protein, 1389 aa, Oenococcus kitaharae; identical to SEQ ID NO: 370
  Oenococcus kitaharae DSM 17330

SEQ ID NO: 372 - protein, 1399 aa, Olsenella uli
MNLRNTTDEYNIGLDMGTNSVGWAVTDKAGAIAHFKGKPTLGSRLFDAAQTAAGARIHRSQRRRYVRRRWRLDLLQSLFQDEVSKVDSEFFCRLRQSRLYVGDREKGHADYTWPIFNDSDFNEVDYYKRFPTIYHLRKWLMETDEKADIRLIYLATHNIVKHRGNFLRENNKSLSSRDANPAQAVKSLRLALNDWCSERDYECAWKGEEDDGAIDEAILNVLADGEKGRSDQAKEIAKLTGVDCGDAKQSKQCNEAIAKAIVGLKVEMKNIFGEFPAEKTSYIYLSSDEDVEAVRESCPDDSGELFQALCKLYSAYILQELLSYADPSGQTISANMVAKYKQYGRDLRLLKELTRTYAPQKYDLFFRGETYAGSSDYVVDEARGYTRYNLGTTKANYDDFQKSVKELFKGTDALQDERYQEMMVAFGEQKFLRRLKTSDNGSIYYQLHLEELHTILENQGKHYPFLLSEEDKIESLVSFRIPYYVGPLTRKNAAIGHDGKERFAWSSRKDGMEHAVITPWNWEEIIDRDKSAEDFIMRMTGDCTYLQGEPVLPKCSLLYEEFCALNEFNGAHWTVDGDDERRFDAAQRERIMCDLFRRTRSVTYNKVSDWLERKYNFTGARVRGGQGEHGFESKLGSYIFFCKDVFKTDGLDEADYTMIEQIILWSTLFEDRDILKRKIEEAYGGDRLTSEQIKVICKKRFTGWGRLSKRLLTDIKVNTDTGRKSIMDVLREGNPNNGQRSRTMVFMEVLRDEDLGFQKAIDGLNRDYFREHNNGLMDVNDLPGSPAIRRSINQAVRIVDEIASIARKEPTNIFIEVTREEDDPRKKGKRTKRRYDAIKSALEKFKKDDPSLWKELCEKAPGDMDERLSLYFMQRGKCMYSGRPIKIEELHTGKYEVDHIIPRSYIKDDSFENKVLVYREENQHKTDALLIDSSIRQKMGGYWRMLHDAKLVGDKKFRNLFRNHIDDKAMKGFVARQIVETSQMVKLVQTLFEARYPNTRIVPVKAGISHDLREAAGLVKCREANDFHHAHDAFLACRIGLFIQKRHPSVYDNPIGLARIMRDYARMQAREYKKSHCLAHTQGFIVNSFLSSGFDEETGEIFKDDWDAKAEVEGIRRVLNCRQCFISRMPVEGDTRYGGRYWGETIYSPKGKHKHEIPLKQGLDPNLYGGYSDLLYSYFLIYEASDVSSGERVLRFIGIPTSIAARMANQKRLEEYVSRLALQENLEHVRMVRKIMKKQLIEVDNCRLLVTAADAVTNATELAFSLDEMKIISTCAKCINGADPSAIDKIGNAQDSFFDNLKRRGSDRCALLFSQLKLDKLSQNFYMISSDDKSKILISILDRIRAKSNSVDLSLVGGAKHAAQMKFDFNAKLNNPASSFVLIDQSVTGMFERRTRIGL

SEQ ID NO: 373 - protein, 1535 aa, Ornithobacterium rhinotracheale
MNTILGLDLGTNSIGWALIKVLNDKTRLPLEIIDLGVVVIPTDQRTLDKFSKGESISKTAERTKQKGVRKLYERKKLRRERLHRVLNILGFLPEHYSKKIDFKKHLGQFFGNSQPKISYVENDHGKHEFIFMDSYREMLKEFSKHNIKNVPYDWTIYYLRKKALSQKISKEELAWVILNFNKKRGYYQFRDDNADENKENKIEKYYALKVTNVKKEDAQNYTITLENGWIYKNKSKISLLDWVGSTKEFISTEKFDNKGNIIKKKNGEDDRTLKLVDSEKDWIAIKKSTEDRIENYGKTVGTYLYEHLLKDPNQKLNGELINIIDRKFYKNELKQILEKQKEFHPELLNEDLFQKSIIELYPKNSTRQKELKNKDLCYLLIDDVIYYQRDLKKKNSTINKCSFESREYYLNGEKQIQKINCIAKSKPLYQEFRTLQFIKNLKVYEIIDGLEKDITSKLLPDFETKEHFFEWLNDKEKIDQLQLLSYKCFDLHDNVKNDLIAKGIKRPTEKAIRTELLEKYRWNYSKDNDRNFLLNETRFKILKYLKKVDKKLTLTNEQIESLWLLLYSAKDERELKNGLQKFSEKNKLPKKFSDIFISFPPFKKEYGAYSEKALKKLLSLVRFGKYWSFNKIDNNIQNKIMNILNGEVDDSISDRVREKTILLQDKNDFQDLPLWLASYVAYNRFSEVSEIKYWDSPDKIEFLKQHSIGNPIVEKIINETLKLIKDIWVIHGKSCKNFFSEIHIELSREIKSSSKKRAQITNNNTKNQKLNNLIKSLLIEMASDTKYENVTPYSPSQQEILKIYDEGIYSKEENSEKIKEINKIRNNNKISKSDITKYKLWLEQGYISPYTGKIIPLTKLFTAKYQKEHIIPQTKFFDDSFNNKVICEAEVNKLKDNSLAMNFIKAKGGKAVKLSDGETVTILNQEEYKQLVRTSFKKNSIKLRNLLLEEIPDTFTKRQLNDTKYISKLVLSLLSNIVREKGELESTAKRIVSTNGQITSILRNDWGLNNIWNKLITPRFERLNNINKNKIYGNWENKKGKNVFQINYLNDNLSTLNTKRIDHRHHALDALIVACTTRNHINFLNNQYAKSRNQRHDLRAKLKRRETITTEGSKKQVFKDFIKPWESFTQDALKKLETTIVNFKVNKRIINKTINWYKKWEKQKDGTYKKIQKKQTKGDAWAIRKPLHIDTIYGIVCKKLPLKSALENYKNIIDENLKHKIKELKEVNKFDNNQIINFFKECNFIFEDNNIQKVEVYDFKDNRDKTILSSSRQLIDESFTPKKIGKVLDPTIRNILLKHLNSTKYNNKFDSDGNPIKPEKLAFSPEGLKDLNKNIKHLNNNKEHQPIKRVKLFETLGNKIKVGYTQQKNKKFAETATGTNLFLGIYSDNNKRDFKTIPLILAIQREKEGLNPCPDTDEKGNQLLFSLSPNELVFVPNNEERKNPNLVDFENLSKDQIDRIYKFVSCTGSEAYFVPSRTAKPIIENENGTNNKSQRIIEFNEKTSIKNEKNEPVLIKTICWKIEVNRLGKIIKVIK

SEQ ID NO: 374 - protein, 1443 aa, Parabacteroides johnsonii
  Parabacteroides johnsonii DSM 18315
MIKLLYLEKLKQYTMKKILGLDLGTSSIGWALVNEAENSDEVSSIIKLGVRVNPLTVDEMQNFEKGKSITTNADRTLKRSMRRNLQRYKLRRDALIELLKKVGFITDKTILSEQGNRTTFETYRLRAKAAEEEISLKELARVLLMINKKRGYKSSRKAKGEEEGALIDGMEIAKKLYDEDLTPGQLCLQLLESGKKFFPDFYRSDLQEEFNKIWDFQKQFNLFSFCDVAKEEVKGKNKSQTWAILAKYFVETKKVNVWNEHEAQTENREEVYKLVGLKRTVKGEELKKENYRWRVQALTEQLDLEKIAVVLQEINGQISASSGYLGAISDRSKVLYFNRQTVGQYQMAELNKNPNMSLRNMVFYRQDYLDEFNVIWEKQAEFHKELTPELKKEIRDIIIFYQRRLKSQKGLISFCEFENREVVVEKEGKKQTKIIGCKVIPRSHPLFQEFKIWQTLNNIEVFVGEKKGKRKKSNVSSDLFGDTEDALITEGRRFLYQEEKKILAKELSIKKGLTKAEILRLLFENPQELDINFKQIDGNQTGFALFSAYSNMIEKYGYEPLDFKKPAEDLISQLKTVFTDLGWNTDLLFIDLDKENKEWEKQPYFRLWHLLYSFEGDNTPTGNGKLIEKIMQLCGIEKEYAIELANVSLQDDYGSLSAKAIKKILLYLKEGNQYDMACEYAGYRHSKSSLTKEEIENKVLKDKLEILPKNSLRNPVVEKILNQMVNVINTVMEVYGRPDEIRVELARELKKSAKEREELTKAVAKNTREHEEIRKVLQSEFGMINVSRNDIIRYKLYEELKDNGYKTLYSNQYIPREKLFSKEIDIEHIIPQSRLFDDSLSNKTLEYKSINIEKGNKTAYDFVKEKYGEEGLQQYLNRCENLCKDKKAKLRKLKMELNEIPDGFIDRDLRNTQYIAKKALSMLTEICRRVVATTGSITDKLREDWQLVDVMKELNLPKYEALGLVEVYEDKDGRKIKRIKDWTKRNDHRHHAMDALTVAFTKDVFIQYFNNKNAAWESDSKEHTNIVGIKTRYFESGKAVPPIPLGQFRVEAKCHLENLLVSIKAKNKVVTTNVNCIKKKGGTYKNTQQTPRGQLHLETIYGSHNQYVTKIEKVNASFDAVKIATVSKQDYRNALLKRLEVFGNDPKKAFTGKNSLEKNPIYLDRAQTIQVPDKVQTVELETAYTIRKPVDPTLNVDKVVDKKIRLILEQRLKEYGGDAKKAFVNLDENPIWLNEEKGISIKRVTIRGISKAQALHDKKDKDGNFILDETGKRIPVDFVNTGNNHHVAIYRKPVLDKKGQVIFDDEGNPMYELDEDVVPFFEAVTRANLGIPIIDKDYKKSEGWQFLFSMKQNEYFVFPNEKTGFNPKEVDLLDPDNYAMISPNLFRVQKIGLNDYTFRHHLETTIQNDLKFITWIRCGKSGIKDIVKVRINHIGQIVSVGEY

SEQ ID NO: 375 - protein, 1424 aa, Parabacteroides sp.
  Parabacteroides sp. D13
MKRILGLDLGTNSIGWALVNEAETDEEVSSIIRLGVRVNPLTVDETQNFEKGKSITTNAERTLKRSMRRNLQRYKLRRDALVEFLKELGFITDETILSEQGNRTTFETCRLRAKAAEEEISLEELSRVLLMINKKRGYKSSRKVKKEEDGVLIDGMEIAKKLYEEDLTPGQLCSQLLESGKKVLPDFYRSDLQEELDRIWSVQKQFHPDVFCDAAKEEIKGKNRSQTWAILANYFVWKEEVVGWNDREAKNETIEKECKLVGLKRTTKGYELKKENYRWRAQALTEQLGLEEIAVVLQEINGQINASSGYLGAISDRSKVLYFNHQTVGQYQMAELDKNPHASLRNMVFYRQDYLDEFDRIWEKQAEFHKELTAELKKEIRDMIIFYQRRLKSQKGLISFCEFERLEIVVEKDGKKQTKVIGCKVIPRSHPLFQEFKVWQTLNDIKVLGREKKRNALSASESRALYPEEKEILARELAIKENMKKADVLKLLFENPQELDLNFKQIDGNRTGFSLFSAYSKMIEKYGYEPLDFKKPADEIIGQLRTIFTDLGWNTNLFTIDLTKEGKELEMQPYFRLWHLLYSFEGDNTSTGNGKLIEKIMQLCGVEKEYAVELASLSFQDDYGSLSAKAIKRILPYLKEGNLYDVACEYAGYRHSKSSLTKEEIENKVLKGKLEVLPKNSLRNPVVEKILSQMVNVINTIIDTYGKPDEIRVELARELKKSAKEREELTKAIAKSTREHEEIRKLLQDEFGMMNVSRNDIIRYKLYEELKDNGYKTLYSNQYIPKEKIFSKEIDIEHIIPQSRLFDDSLSNKTLEYKAINIEKGNKTAYDFVKEKYGEEGLQQYINRCESLFNDKKAKLRKLKMEQKDIPDGFIDRDLRNTQYIAKKALAMLNEICRRVVATTGSITDQLREDWQLVDVMKELNLPKYEALGFVETYEDKDGRKIKRIKDWTKRNDHRHHAMDALTVAFTKDAFIQYFNNKNAAQDSGNRNHTNIIGIKTRYFDKGRALPPIPLEQFRIEAKQHLEKLLVSIKAKNKVVTVNVNRTKKRKGENTKIQQTPRGQLHLETVYGSHKQYVTKIEKVNASFDAAKIATVSKRAYRNALLKRLETFGNDPKKAFTGKNALEKNPLYADKYQTIRVPEKVQTVEFETIYTIRKPVDPALNVDKVVDVKVRAILERRLKEYGGDPKKAFVNFWENPIWLNKEKGISIKRVSIRGINNAQSIHVKKDKNGNPIWDENGKQIPVDFVNTGNNHHVAIYRKPVLDKKGQVTFDEDGNLMYELDEVVVPFFEAVTRANLGLPIIDKDYRKSEGWQFLFSMKQNEYFVFPNEKTGFNPKEVDLLNPDNYAMISPNLFRVQTMSKVMYGNNVVRDYKFRHHLETTVKDMKELKDIAYKQYKTLSFGNSVVKIRINHIGQIVSVGEY

SEQ ID NO: 376 - protein, 1428 aa, Parasutterella excrementihominis
  Parasutterella excrementihominis YIT 11859
MGKTHIIGVGLDLGGTYTGTFITSHPSDEAEHRDHSSAFTVVNSEKLSFSSKSRTAVRHRVRSYKGFDLRRRLLLLVAEYQLLQKKQTLAPEERENLRIALSGYLKRRGYARTEAETDTSVLESLDPSVFSSAPSFTNFFNDSEPLNIQWEAIANSPETTKALNKELSGQKEADFKKYIKTSFPEYSAKEILANYVEGRRAILDASKYIANLQSLGHKHRSKYLSDILQDMKRDSRITRLSEAFGSTDNLWRIIGNISNLQERAVRWYFNDAKFEQGQEQLDAVKLKNVLVRALKYLRSDDKEWSASQKQIIQSLEQSGDVLDVLAGLDPDRTIPPYEDQNNRRPPEDQTLYLNPKALSSEYGEKWKSWANKFAGAYPLLTEDLTEILKNTDRKSRIKIRSDVLPDSDYRLAYILQRAFDRSIALDECSIRRTAEDFENGVVIKNEKLEDVLSGHQLEEFLEFANRYYQETAKAKNGLWFPENALLERADLHPPMKNKILNVIVGQALGVSPAEGTDFIEEIWNSKVKGRSTVRSICNAIENERKTYGPYFSEDYKFVKTALKEGKTEKELSKKFAAVIKVLKMVSEVVPFIGKELRLSDEAQSKFDNLYSLAQLYNLIETERNGFSKVSLAAHLENAWRMTMTDGSAQCCRLPADCVRPFDGFIRKAIDRNSWEVAKRIAEEVKKSVDFTNGTVKIPVAIEANSFNFTASLTDLKYIQLKEQKLKKKLEDIQRNEENQEKRWLSKEERIRADSHGICAYTGRPLDDVGEIDHIIPRSLTLKKSESIYNSEVNLIFVSAQGNQEKKNNIYLLSNLAKNYLAAVFGTSDLSQITNEIESTVLQLKAAGRLGYFDLLSEKERACARHALFLNSDSEARRAVIDVLGSRRKASVNGTQAWFVRSIFSKVRQALAAWTQETGNELIFDAISVPAADSSEMRKRFAEYRPEFRKPKVQPVASHSIDAMCIYLAACSDPFKTKRMGSQLAIYEPINFDNLFTGSCQVIQNTPRNFSDKTNIANSPIFKETIYAERFLDIIVSRGEIFIGYPSNMPFEEKPNRISIGGKDPFSILSVLGAYLDKAPSSEKEKLTIYRVVKNKAFELFSKVAGSKFTAEEDKAAKILEALHFVTVKQDVAATVSDLIKSKKELSKDSIENLAKQKGCLKKVEYSSKEFKFKGSLIIPAAVEWGKVLWNVFKENTAEELKDENALRKALEAAWPSSFGTRNLHSKAKRVFSLPVVATQSGAVRIRRKTAFGDFVYQSQDTNNLYSSFPVKNGKLDWSSPIIHPALQNRNLTAYGYRFVDHDRSISMSEFREVYNKDDLMRIELAQGTSSRRYLRVEMPGEKFLAWFGENSISLGSSFKFSVSEVFDNKIYTENAEFTKFLPKPREDNKHNGTIFFELVGPRVIFNYIVGGAASSLKEIFSEAGKERS

SEQ ID NO: 377 - protein, 1037 aa, Parvibaculum lavamentivorans
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 378 - protein, 1058 aa, Pasteurella multocida
  Pasteurella multocida subsp. gallicida X73
MQTTNLSYILGLDLGIASVGWAVVEINENEDPIGLIDVGVRIFERAEVPKTGESLALSRRLARSTRRLIRRRAHRLLLAKRFLKREGILSTTDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKESAESATFMELKAWHAIRKALENQGLKDTWQDLAKKPDLLDEIGTAFSLYKTDEDIQQYLEGKLPDSVINALLVSLNFDKFIELSLKSLRKILPLMEQGKRYDQACHEIYGHHYGEKNQQISQLLPVIPTQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKVRENNDRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYVGLKARLAEFNQDPAKAFATPFYKQGGQQVKAIRVELVQKSGVLVRQGNGVADNAPGSIVRTDVFIKNNKFFLVPIYTWQVAKGILPNKAIVAHKNEDEWEEMDEGAKFKFSIFPNDLIELRTKTECFLGYYIGPDRHNGSISLREHDSEISKGNAGVYRVGVKLALSLEKYHIDELGKNRRICRPHQRRPVR

SEQ ID NO: 379 - protein, 1056 aa, Pasteurella multocida
  Pasteurella multocida subsp. multocida str. P52VAC
MQTTNLSYILGLDLGIASVGWAVVEINENEDPIGLIDVGVRIFERAEVPKTGESLALSRRLARSTRRLIRRRARRLLLAKRFLKREGILSTTDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVFLNFDKFIELALKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKIRENNDRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFTTPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 380 - protein, 1056 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 381 - protein, 1364 aa, Pediococcus acidilactici
  Pediococcus acidilactici DSM 20284
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEKDRKFDFREIYLAVHHIIKYRGNFLNGTPMRSFKVENIELDTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKEIKRLIQLDQFMPKQRTGQNGAIPHQLHQQELDQIIEKQSKYYPFLAEPNPNVKRRKDAPYKLDELIAFKIPYYVGPLVTPEEQAQNGENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTGNFMQIQSRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLQPYFVYDNFKKFGNKEDIGHKRFNFLGKIEREKKVVAPETGEILWSNVAPNETIKQIKKVYDYKFMIVSREITTRRAELFNQTVYPKNYHGKLIPIKEDRPTDLYGGYSGNTDAYLAIVALEDKKKGKYFKVVGIPTRVAAKLEKLKQQDSQQYLQALHKVIAPQFTKSTKKGIKKTEFEIVLDKVHYRQLVQDGPVKMMLGSSTYKYNAKQLVLSEKALQVIADDRKFDETQKDDNLIAVYDEILSIVNQSFDLYDINGFRKKLNDNRDQFIDLPAETKYEGRKVVAHGKREMILEILKGLHANAAFGNLKPIGFSTAFGQLQVPNGIILSKNAILIHQSPSGLFERKIKLSDL

SEQ ID NO: 382 - protein, 1366 aa, Pediococcus acidilactici
  Pediococcus acidilactici MA18/5M
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEEDRKFDIREIYLAVHHIIKYRGNFLNGTPMRSFKVENIELDTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKEIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTENFMQIQTRPEFAALIQQANEKQFEGNDPNNVWENIESILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGKYLYKCYPKLRPYFVYGKFKKFGDNEDIEVGDGRFNFLNRIERLKNVTDPETGEILWSNVAPNETIKQIKKVYNYKFMLVSRETTTRRAELFNQTVYPKNYRGKLIPIKEDRPTDLYGGYSGNTDAYLAIVALEDKKKGKYFKVVGIPTRAAAKLEKLKQQDSQQYLQALHKVIAPQFTKSTKKGIKKTEFEIVLDKVHYRQLVQDGPVKMMLGSSTYKYNAKQLVLSEKALQVIADDRKFDETQKDDNLIAVYDEILSIVNQSFDLYDINGFRKKLNDNRDQFIDLPAETKYEGRKVVAHGKREMILEILKGLHANAAFGNLKPIGFSTAFGQLQVPNGIILSKNAILIHQSPSGLFERKIKLSDL

SEQ ID NO: 383 - protein, 1364 aa, Peptoniphilus duerdenii
  Peptoniphilus duerdenii ATCC BAA-1640
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 384 - protein, 1087 aa, Phascolarctobacterium succinatutens
  Phascolarctobacterium succinatutens YIT 12067
MLRMKYAIGLDIGIASVGYAVLALDHEENPWGIIRLGSRIFDVAENPKDGASLALPRREARSVRRRLRRHHHRLERIKNLLINTEFITKDELLHLYDGNLSDVYELRVKALDYSVTNAELTRILLHLAQRRGFKSNRKSDANDKEAGQLLEAVSANAKRMQENHYRTVGEMFYKDDLFSKYKRNKGGTYLTTVHRDMIAAEARTILEKQFALGNNICTQDFIDKYLSILLSQRQFDEGPGEPSPYAGNQIANMIGKCTFEPNEYRAAKASYSFERFNLLQKVNHLRLLLEGKSIALDNEQRKKIIALAHDKADLRYSHIRKALGLDEKVLFNTITYNDDVSVIEKKTKFNFLQAYHQIKKVLAEDMQKLTTEQLDNIGQILSTYKSDNKRTEELSALGLEKKIIDALLGINGLSKFAHLSLKALRKINPYLEEGKIYNEACTAAGYDFKAHANTQKTELLPAYKEEMDDITSPVARRAIAQSIKVINAIIREQKGSPLYINIELAREMAKGFDERTQIDKANKENQAKNERIMERIRTEFHKANPTGMDLIKLKLWEEQDGRSPYSQKAISINRLFEPGYVDIDHIVPYSISFDDSFKNKVLVFSDENRDKGNRLPIAYLQSKFGAKAAENFMIWVQSNIKDYKKRQKLLKREITEEDINKFKERNLQDTKTISRFLYNYINDYLLFAPSDTGKKKRVTAVNGTITAYLRKRWGINKIRANGDKHHAVDAVVIACTTDKMIKDLSSFSRYHELEYTHTDTESFLVNSLTGEILKRFPYPWEDFRPELMARLSDNPADALRKLNLIFYHGIDLSTIKPIFVSRMPRHKVTGAAHKATIKSARCLDNGIVICKTSLQNLKLDKEGEIANYYAPESDTILYNALKERLRSYDNKPAKAFAEPFYKPKADGTPGPLVKKVKVYEKSTLNVAVQQNTAVADNDSMVRVDVFHVKGNGYYLVPIYIADTLKKELPNKAIVAYKPYADWPVMDDSNFIFSLYPNDLIKFEHKNSVKFAKVNKESTLNDFYSTKSEIVYFKGCNINTGAITIINHENTYVVSSLGVKTLPSLEKYQADVLGNYTKVKKEVRKPFR

SEQ ID NO: 385 - protein, 1333 aa, Planococcus antarcticus
  Planococcus antarcticus DSM 14505
MKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 386 - protein, 1197 aa, Porphyromonas sp.
  Porphyromonas sp. oral taxon 279 str. F0450
MLMSKHVLGLDLGVGSIGWCLIALDAQGDPAEILGMGSRVVPLNNATKAIEAFNAGAAFTASQERTARRTMRRGFARYQLRRYRLRRELEKVGMLPDAALIQLPLLELWELRERAATAGRRLTLPELGRVLCHINQKRGYRHVKSDAAAIVGDEGEKKKDSNSAYLAGIRANDEKLQAEHKTVGQYFAEQLRQNQSESPTGGISYRIKDQIFSRQCYIDEYDQIMAVQRVHYPDILTDEFIRMLRDEVIFMQRPLKSCKHLVSLCEFEKQERVMRVQQDDGKGGWQLVERRVKFGPKVAPKSSPLFQLCCIYEAVNNIRLTRPNGSPCDITPEERAKIVAHLQSSASLSFAALKKLLKEKALIADQLTSKSGLKGNSTRVALASALQPYPQYHHLLDMELETRMMTVQLTDEETGEVTEREVAVVTDSYVRKPLYRLWHILYSIEEREAMRRALITQLGMKEEDLDGGLLDQLYRLDFVKPGYGNKSAKFICKLLPQLQQGLGYSEACAAVGYRHSNSPTSEEITERTLLEKIPLLQRNELRQPLVEKILNQMINLVNALKAEYGIDEVRVELARELKMSREERERMARNNKDREERNKGVAAKIRECGLYPTKPRIQKYMLWKEAGRQCLYCGRSIEEEQCLREGGMEVEHIIPKSVLYDDSYGNKTCACRRCNKEKGNRTALEYIRAKGREAEYMKRINDLLKEKKISYSKHQRLRWLKEDIPSDFLERQLRLTQYISRQAMAILQQGIRRVSASEGGVTARLRSLWGYGKILHTLNLDRYDSMGETERVSREGEATEELHITNWSKRMDHRHHAIDALVVACTRQSYIQRLNRLSSEFGREDKKKEDQEAQEQQATETGRLSNLERWLTQRPHFSVRTVSDKVAEILISYRPGQRVVTRGRNIYRKKMADGREVSCVQRGVLVPRGELMEASFYGKILSQGRVRIVKRYPLHDLKGEVVDPHLRELITTYNQELKSREKGAPIPPLCLDKDKKQEVRSVRCYAKTLSLDKAIPMCFDEKGEPTAFVKSASNHHLALYRTPKGKLVESIVTFWDAVDRARYGIPLVITHPREVMEQVLQRGDIPEQVLSLLPPSDWVFVDSLQQDEMVVIGLSDEELQRALEAQNYRKISEHLYRVQKMSSSYYVFRYHLETSVADDKNTSGRIPKFHRVQSLKAYEERNIRKVRVDLLGRISLL

SEQ ID NO: 387 - protein, 1485 aa, Prevotella bivia
  Prevotella bivia JCVIHMP010
MKNILGLDLGTNSIGWAKISIDDNGKYIKDSIKLGSRIIPMSQDVLSNFSKGVTLSQTSERTSFRGARRLRERTLLRRERLHRILHLLGFLPKHYEKAIGWDRNDNKTYGKFINHAEPKLAWCKDNNGKMRFLFMDSFHDMLSEFSEKHPELLANGKKIPLDWTIYYLRKKALYKAITKEELAWILLNFNQKRGYYQLRGEEDRDSEANKKEYLELKVIGVEATGEKKGNDIWYNIHLENGWIYRRSSKNPLNDWLGKVKSFIVTTDLDADGNPKKDKDGNIKRSFRAPSEGDWTLIKKRTESLLENSGQTVGQFIYNHILEEPSAKIRGNFIRTIERKYYKDELKAILEKQKEFHHELSSESLLTECAKELYKRNIAHQEVLLKKGIIHLLLNDILFYQRPLKIKKSLIDNCPYENYKYVDKKSGDIKVKSIKCIAKSNPFFQEFRLWQFVSNLRLYRKSDDKDVTSEHLVTTDDYANLFTYLNNRKDIKQSVLLKEYFKIKKVKTINGAEYPVRWNYIDDDNKTYPCNETRYDILHALSKTELKSEWLTPERTYRLWHLLYSIESKEETKKALNKLNLSDDFTEAFLTIKPFKKEYGSYSEKAIKKLLSLMRMGYLWSEDEAIKQVGAEIEKTIEGELPDYVLQRLEKSQHNYNKISDFSGLPLWLASYIIYGRHSEAKEIIHWDNPESMMAYIKDFRQHSMRNPIVEQCVLETLRTVHDIWKEIGHIDEIHIELGREMKSTSEQRKAITQNVLHNQNTNIRIKLLLQELKNDNNITGVRPYSPMQQEILRIYEEGALQGLTKEDKDYNDILKISQTAQPTSNELTRYKLWLEQKYRSPYTGKAISLSKLFTSAYQIEHVIPQSRYFDDSLSNKVICESEVNTLKKAMLGMEFIKTCGGQKVHCTLLGDVEIYNEEDYKAFVNEHYSNNRTKRNKLLMEDIPQEFINRQLNDSRYISKMVKQLLSAIVRGQEEVEATSKFVIPCTGGITDRLKKDWGLNDIWNNLVSPRFQRMNALTGSEYFGHWENKEGKRVFQTTMPIQLQQGFSKKRIDHRHHAMDALVIACASRNIISYLNNETAQDTERRRDLRQKLCDKGGSVRKPWDSFTQDTQYALKDIIVTFKNYVRIINKATNYYEHYKTDGKKGMISQKGDELWAIRKPMHKETVFGKVNLRRPKRVSLSKAIDSVDIICNRKLKKYIKARLNEGLQKKQILNIFKELNNVWEGIDVNKIDIWEMSNDKEPMVATRKQLDTSFDEKKIRSISDTGIQKILLNYLITKNNNPELAFTPEGIQEMNSNISEYNDHKKHQPIYKVRVTEPLGAKYPIGTMGNNPKKFVEAQAGTNLYFAIYEDKEGKRNYDTIPLNIAAERLNQQLSPVPETNENNTPLKFYLSPNDLVYVPSEEERHSGNNIQLDKNRIYKMVSSTSKRCFFIHHRVAISLVDKKEFSAQNKMERSIDNEQVMIKSVCWKLITDRLGNIIKVIK

SEQ ID NO: 388 - protein, 1457 aa, Prevotella buccae
  Prevotella buccae ATCC 33574
MKTILGLDLGTNSIGWAKVSVDDYGNYLHDIKLGSRIIPMSQDVLGNFDSGVTVSQTAQRTEFRSKRRLVQRNLQRRERLHRVLHVLDFLPAHYDAAIGWDRTEAVTYGKFLNHAEPKLAWEELGNGKRRFLFMDSFHEMVADFARCQPALVADGKKIPLDWTIYYLRKKALTQAITKEELAWILLNFNQKRGYYQLRGEEEEENPTKQEEYYELKVVSVEATDSRKGNDTWYNVHLENGWIYRRSSKISLDDWVGKVKQFIVTTEYEKDGATLKTDKEGYVKRSFRAPNENDWGLRKKRTETLLEMSGKTVGAFIYDHLLQEPADKIRGNFIRTIERHYYKAELEAILAEQCKYHIELRDKEMLEACARELYLNNLPHQRSLMKKDMTYLLLYDLIFYQRPLKSKKALIANCPYEYYEYVDKETGEIKRQNIKCIAKSNPYFQEFRLWQFVLNLRLFDRVEDKEVTANYLPTADDHARLFTYLNDRKEINQETLLKDYFKLKKVKIGNEKEYPIRWNYIEDKEKKYPCNETRYELLMALDRAGIEHKWLDDNNLEYRLWHLLYSVEVKSESETALRKLKNDDAFVNSFLKVKPFKKEYGAYSEKAIKRLLAVMRKGFLWNEQDICDETRKRIEIIIKGDVDEKVKERMGHAAYSFDRVSDFQGLPEWLACYVVYGRHSEAMDIQHWDSPERLMAYINNFKQYSLRNPIVEQCILETLRTVHDIWKETGQIDEIHVELGREMKSTSEERARRTQNVLRNENTNLRIKSLLIELKNDTDICNVHPYSPMQQEILRIYEEGALQELNREDEDFEEISKISQMSQPSGKELNRYKLWLEQKYRSPYTGKAISLAKLFTPAYQIEHVIPQSRYFDDSFTNKVICEAEVNTLKSNLLGYEFIKKHGGEIIHCTTLGDVRIFSESEYKAFVMDHYANNKSKKDKLLMEDIPQEFLSRQMNDSRYISKVVKTLLSNIVRMADESEATSKSVIVCTGGVTDRLKKDWGLNDVWNSIVYSRFERLNRLTGTEAFGHWENKDGKRVFQTSMPLELQRGFRKKRIDHRHHAMDALVIACASRNIVNYLNNESANNPKKREDLRRQLCDKNRVIRKPWETFTQDAYNALENVVVSFKNYVRVINKATNRYEHYDENGKKRFVQQKGSELWAIRKPMHKETYYGHVNLRRKELVTLQKALDDIPSICDKKLRDYISALVEKHFNKRQLLAHFKSTDYYWQKQYVNKVYVWTFSDDIKPLVATRKLLDTSFDAKRIGTITDTGIQKILRNYLEAKGGNATLAFTPEGIAEMNQNISKYNDGKPHQPILKVRITEPMGAKYRVGQTGNKMAKYVEAQSGTNLYFAIYEDSEGKRSYTTVPLDEVAERLKQRLSPVPEKDENDVPLKFYLSPNDLVYVPTEEELQLRECKLNKDRIYKMVSSTGNECHFIPYYVANVIYNKGGFNMQMHRPQS

SEQ ID NO: 389 - protein, 1218 aa, Prevotella buccalis
  Prevotella buccalis ATCC 35310
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYHEQGNKVRIRQRYTDRKKHYQHEFDAICEKQELSSELIEDLQRAIFFQLPLKSQRHGVGRCTFERGKPRCADSHPDYEEFRMLCFVNNIQVKGPHDLELRPLTYEEREKIEHLFFRKSKPNFDFEDIAKELAGKKNYAWIHDKEERAYKFNYRMTQGVPGCPTTAQLKSIFGDDWKTGIAETYTLIQKKNGSKSLQEMVDDVWNVLYSFSSVEKLKEFAHHKLQLDEENAEKFAKIKLSHSFAALSLKAIRKFLPFLRKGMYYTHASFFANIPTIVGKEIWNNEQSRKYIMENVGELVFNYQPKHRDVQGTIEMLIKDFLANNFELPAGATDKLYHPSMIETYPHALRNEFGILQLGSPRTNAIRNPMAMRSLHVLRRVVNQLLKESIIDENTEVHVEYARELNDANKRRAIADRQKEQDKQHKKYGDEIRKLYKEETGKDIEPTQTDVLKFQLWEEQNHYCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYHMEETFRQGRGSKPKFSKPWATFTEDVLNIYKNLLVVHDTPNNMPKHTKKYVQTSKGKVLAQGDTARGSLHLDTYYGAIERDGEIRYVVRRPLSSFTNPKELENIVDETVKRTIKEAIADKNFKQAIAEPIYMNEDKGILIKKVRCFANSVKQPINIRQHRDLSKKEYKQQYHVMNENNYLLAIYEGLVKNKVVREFEIVSYIEAAKYYKRSQDRNIFSSIVPTHSTKYGLPLKTKLLMGQQVLMFEENPDEIQVDNTKDLVKRLYKVVGIEKDGRIKFKHHQEARKEGLTIYSTPYKNNDDYVPIFRQSIKNINILVDGIDFNIDILGKVTLKE

SEQ ID NO: 390 - protein, 1422 aa, Prevotella denticola
  Prevotella denticola CRIS 18C-A
MTQKVLGLDLGTNSIGSSVRNLDLSDDLKGQLEFFSSDIFRSSVNKESNGREYSLAAQRSAHSRSRGLNEARRRKLWATLDLLIKYGFCPMSPESLMRWRTYDKQRGLFREYPIDDKNFNAWILLDFDGDGKPDYSSPYQLRRELVIRQFDFDQPIERYKLGRALYHIAQHRGFKSSKGETLSQQETNSKQSLTDDTADVAGEMKASEEKLSKGLSTYMKENNLLTVGAAFAQLEDEGVRVRNNNDYRAIRSQFQREIETIFKFQQGLSVENELYERLVSEKKNIGTIFYKRPLRSQRGNVGKCTLERTKPRCAIGHPLFEKFRAWTLINNIKVRMSEEEQAEQLPMKLRFELYNDCFLAFVRAEFKFEDIRKYLEKRLGVHFSYNDKTINYKDSTSVAGCPITARFRKLLGEDWESFHVDGQKQRQAHGKNNASFHTVSYSTNDIWHFCYDAEEPEAVLSFAQDNLKWEKKKAEELVRIWSAIPQGYAMLSQKAIRNINKMLILGLKYSDAVLLAKVPEIVEITDGEILSVTEDYHRVEAQVGYEKQINNIVNALIAKYKSASEEYRFADHNYEYQLDKSDEKDIIKQIESNIGTRKWSLLDADEQTDILQKVRDKYQNFFRSHERKFVESPKLGECFEEYLMKKFPMVEGERWKKLYHPSQIAIYRPVPANKDRSALRLGNPDIGAIKNPTVLRVLNTLRKRVNQLLDDGIISPDETRVVVETARELNDANRKWALDTYNRIRHDENEKIKKILAEFYPKRDNISTVDIDKARYVIDQREMDYFTEAKTYHKDIKKYKLWLEQGGQCMYTGRTINLSNLFDPNSFDVEHTIPESISFDSSDMNLTLCDAHYNRFIKKNHIPADLPNYDKSVVIDGKEYSPIKPRLQRWADRVERLNRNVEYWRGQARRAQNKDRKDQCMREMHLWKMELEYWTKKLERFTITEVTDEFKNSQLVDTRVITRHAVLYLKSIFPHVDVQRGDVTAKFRKILGIQSVDEKKDRSLHSHHAIDATTLTIIPGAAKRERMLELFAKIEEVNKMLSFSGNEDRTGLKQELDGLKNQLNKEVKACRIGHNVSEIGTFINDNIIINHHVKNQALTPVRRRLRKRGHIVGGMDNPRWQTGDALRGEIHKASYYGAITQYAKDKEGKVLMKEGRPQINPTIKFVIRRELKYKKSSTDSGFASWDDLGKAIVDKELFALMKGQFPEGTSFKDACEQGIYMIKKGKNGEVDTKLYRIRHIRCKTKQKNALKIKEQAYKSEKEYKRYFYAAVGDLYAMCCYTNGKTREFKIYSLYDISCHRKVGVEDIPEFITDKKGNRLMLDYKLHTGDMILLYKENPEELYDLDNVSLSKLLYKINGFENDGLRIRMVNHLVAKEAMGESVKDYAKLPDIIRCGVKTIKFLVMGENRDFVIKNGKISFNHR

SEQ ID NO: 391 - protein, 1375 aa, Prevotella histicola
  Prevotella histicola F0411
MKKILGLDLGTTSIGWALVYESENTDEKSSIVRLGVRVNPLSVDEKGNFEKGKAITTNADRQQTHGARINLQRYKLRRENLKDCLQKQGWIGTEALCEEGKTSTFETYMLRAKAAEEEISLHELCRVLFMMNKKRGYKSNRKANNKEDGKLFDGMTVAKKLYEEHLTPAEYSFQLLSSGKKFKQEYYRSDLKEEFDRIWNEQQKYYPEILTDDFKQQLQGKSKGNTSKIFLGKYGIYSADLKGLDRKLQPLKWRVEALKQQVDKEVLAFVISDLNGQIASTSGLLGAISDRSKELYFNKQTVGQYLWTSLKETPHVSIKNKPFYRQDYLDEFEKIWETQATYHKELTPELKQEIRDIIIFYQRPLKSKKGLISVCELEQRKVKVTIDGKEKEISIGPKVAPKSSPMFQEFRIWQNLNNILLIDKGNNSIHPLYEEEKNLLYEELSVKEKLSKAEALKVLNKNSKQWDLNYKEIEGNRTQAVLYDCYNRIIVMTGHEEYNFKKLKASEIRSYVKTTFTGLGFNTDILEFDSSLTGHELEKQPMYQLWHLLYSYESDNSRTGNDALLRKLETAFGFPKEYAAVLSDVVFEDSYGNLSVKAMRKILPHLQAGLNYSQACEEAGYKHSRRSLTKNELDQKEYKEKLELLPKNSLHNPVVEKILNQMINVINAVIDEYGKPDEIRIELARELKIGAAERENMTRSINQGNAENKRIREILEKEFALSYISRNDIIKYKLYEELKSNGFKTLYSDTYISKDKLFSKDFDIEHIIPKARLFDDSLSNKTIEARDVNIAKSNKTAFDFISEKYDQQGIEAYKKKLDILLQDGSISKAKYNRLLMKEADIPSGFIDRDLRDTQYIAKKAYEILSDLVRNVTPTTGAVTSRLREDWQLVDVMKELNFEKYQKLGLVEVIEDRDGRKIKRIKDWTKRNDHRHHAMDALTIAFTKPSYIQYLNNLNARSDKNSSIYGIENKELHREDNKLRFNAPLPINEFRAEARRHLKSILVSVKAKNKVMTQNVNVIKTKHGVIKKVQLTPRGELHNATFYGTKKRPIIKMVKVGAALDEVTIKKVSSSFIREALLDRLHEYNGDAKKAFTGRNSIDKNPIYIDEEHKKTVPALVKTIEWEMYHPTRKLISPDLKIDKVIDKGIREILKTRLAKFNGDAQKAFSNLDENPIYKDEAKKITLKRVSLEGVSSVIPLHTLKDREGKLVVGKDGKPVLGDYVQTSNNHHIAFYMDENGNLQDNVVSFFEAAERKSQGVPVIDKNYNHDKGWNFLFTMKQNEYFVFPNEVTGFNPSEVDLMDEANYSIISPNLYRVQKMSKASGRDYWFRHHLEAMLNDDPKLRNSMFKRITSLKALEGIVKVRINCIGKIVAVGEYD

SEQ ID NO: 392 - protein, 1380 aa, Prevotella intermedia
MKRILGLDLGTTSIGWALVNEAENNNEASSIVRLGVRVNPLTVDEKSNFEKGKAITTNADRQLRHGARINLQRYKLRRQNLHDCLQKQGWLGTEAMYEEGKASTFETYKLRAKAAEEEISLHEFARVLFMLNKKRGYKSNRKANNKEDGQLFDGMTIAKKLYEEHLTPAEYSLQLLNKGKKFTQGYYRSDLNAELERIWDEQKKYYPEILTDEFKQQLEGKTKTNTSKIFLAKYGIYSADLKGLDRKFQPLKWRVEALQQQVDKEVLAFVISDLKGQIANTSGLLGAISDRSKELYFNKQTVGQYLWASLEENPHISIKNKPFYRQDYLDEFEKIWETQAAFHKQLTPELKQEIRDIIIFYQRPLKSKKSLISVCELEQRKVKATIDGKEKEITIGPKVAPKSSPVFQEFRIWQNLNNVLLIDNDTNEKRPLDEVERNLLYKELSIKAKLSKTEALKILNKKGKQWDLNYRELEGNRTQAILFDCYNRIITLTGHEECDFKKIKASEIRHYVSTIFKNLGFSTEILDFDPSLKKHELEKQPMYQLWHLLYSYESDNSRTGNESLLRKLETTFGFPEEYATVLCDVVFEEDYGNLSVKAMREILPYLQAGNDYSQACAYAGYNHSRHSLTKEELDQKVYKERLELLPKNSLRNPVVEKILNQMINVINAIIDEYGKPDEIRIEMARELKSSAADRKKTTHAISQGNAENQRIREILEKEFSLSYISRNDIIKYKLYEELEPNYYKTLYSDTYITKDKLFSKDFDIEHIIPKARLFDDSFSNKTLEARNINLEKSNKTAFDFIKEKYGEDGAEAYKKKLDMLLENDAISRPKYNNLLRAEADIPSDFINRDLRNTQYIAKKACEILGELVKTVTPTTGKITNRLREDWQLVDVMKELNFEKYEKLGLTEIVEDRDGRKIKRIKDWTKRNDHRHHAMDALAIAFTKPSFIQYLNNLNARSNKGDSIYAIENKELHYEEGKLRFNAPIPVNEFRAEAKRHLSAILVSIKAKNKVMTQNVNKIKTKHGIIKKIQLTPRGPLHNETIYGTKMRPIIKMVKVGAALDEATINKVSSPAIREALLKRLNEYSGNAKKAFTGKNTLEKNPIYLNAGRTKTVPSLVKTVEWESFHPTRKLIDKDLNVDKVVDKGIREILKARLEEFNGDAKKAFSNLEENPIYLDEAKKIALKRVSIEGVLSAIPLHTLKNQAGKPITGKDGKPVLGNYVQTSNNHHIAFYYDEDGNLQDNAVSFFEAAERKSQGIPVIDKDYNRDKGWRFLFTMKQNEYFVFPNEATGFIPSEVDLTDEANYGIISPNLYRVQKVSRIDKGTSASRDYWFRHHLETILNDDAKLKNLAFKRIRGLLELKDIIKVRINSTGKIVAVGEYD

SEQ ID NO: 393 - protein, 1425 aa, Prevotella micans
  Prevotella micans F0438
MIQKIFGLDLGTNSIGSSVRNLELGENLTEQLEFFSSDIFGSSVSKNSNGREYSLAGNRSAHRRSRGLNEARRRKLWATLDLLIEHGLCPMSPDSLMQWRTYDKQKGLYRQYPIEDKDFNAWIMLDFNGDGKPDYSSPYQLRRELVVRQFDFDQPIERYKLGRALYHIAQHRGFKSSKGETIADQEKNEKKPIAEEGADIANEMKASETKLSKGLVAYMQENHLKTVGEAFAKLEDERVRIRNNESYRAIRSQYQDEIKEIFTYQKKLSVESELYERLTSEKKGVGTIFYKRPLRSQRGNVGKCTLERNKPRCPIGRPEFEEFRAWTLINNIKIRETAGEPYKQLPIKLRQELLKDCFLSKVKADFKFEDIRKYIEKRLGLSFSNDDKTINYKDSVSIAACPVTVRMKKLLGENWANCRIDGEKRRQAHGKNNNNEHIVSYTEEDIWHVCYNAEDPEEVSNFARKALHWDENKIKELVRLWTSIPQGYAMLSLKAIRNINRMLLLGLKYSDAVLLAKLPDIVPVSDEDILAITKEFLQLEDKLNQEKQINNIVNSLIANYKSKLEENRFADHNYQYQLGEGDDEDINTQIKSHIGAKLWVQIGADEQTKIFQAVRSKYQDFFKSYKRKFVESPKLGELLVAFLTEKFPNVKSKQWERLYHPSQIAIYRPIPVDNDRSKLRLGNPNIGAIKNPTVMRVLNTLRRRVNQLLDDGVISPDETRVVVETARELNDANTKWALDRYNRIRRDENEKIRKILKELNPTTNSISEQDIDKARYIFEQCETDFYTDGKVPYYNKDIKKYKLWLEQGGQCLYTGQTINLTNLFNPNAFDMEHTIPKSISFDNSDQNLTLCESYYNRFIKKNNIPTDMPNYDKDVTINGKEYTAIKPRLQRWKERVDRLSRNVDFWKGQARRAQDKDRKDECIREKHLWDMELAYWKGKLERFTMTDVTDGFKNSQLVDTRVITRHAVLYLKSIFNHVEVQRGETTAEFRKILGLQSIDEKKDRSLHSHHAIDATMLTVIPSAAKRDRMLELFYKIEETKKALKNYNDNNKTGLNLELKGLEEKLDKEKKDCRVGRRVNDLDRFINENIIVSHHTKDQALTPAHRRLRKRGKIVGGKEHPRWQTGDSLRGEIHKASYYGAITQFAKDANGKVLMKDGQAQIDPTIYYVIRRELKYKRSTQDSGFTNWEDLEKVIVDTDLFGLMKGQFPEGTSFKDACEQGFYMIKKGKNGEGDVKTHRIRHVRCKAVKTALRIKEQTYKSSKDYKQFFYAAVGDLYVMCYYTDGKKRDFKIYSLYDISNHRKSGTEDIPKFITDKKGNHLPLDYKLRTGDMVLLYKDNPEELKDLDQVNLKRRLYKVNRFESEGLIILLTHHLSTTTERGCSIGKIENYQNLPTAIRCGIKTIKFLIMGKHRDFVIRNGNIEFKH

SEQ ID NO: 394 - protein, 1506 aa, Prevotella nigrescens
  Prevotella nigrescens ATCC 33563
MKTILGLDLGPNSIGWAKVEVDDEGNYLRNIKLGSRIIPMTQDMLGDFDKGVKVSQTAIRTDFRGNRRLIERHLLRRERLHRVLHALKFLPKHYEDAIGWDRNEPATYGKFVNNSEPKLAWERQEDGSMRFLFMESFNEMVADFAQNQPSLVSDGKKIPLDWTIYYLRKKALTRPIKKEELAWILLNFNQKRGYYQLRGEEEEDNLTKRKEYYKLKVVGVEADGAPKGGKTWYNIHLENGWTARCQSKIPLDDWVGKVKEYIVTTEYEDDGKTPKCDKEGKVKRSFKSPEKDDWQLIKTRTEKFIDDSNKTVGAFIYDYLLEKPFDKIRGKYIRTIERKYYKNELREILREQTKYHEGLHSLEALKICAEELYKNNQQHQEYLLKKDMTFLLLNDLIFYQRPLKSKKSLIADCPYEVYKYDDKLTGKKGQKKIKCIAKSNPYYQEFRLWQFIANLRLFSVTDGKEVTAEYLKTEEDYVRLFSFLNDRKDIKQETFLRSFLKLKKESIGSEKIYPIRWNYIEDANKSYPCNATRHELLLAFDRADIPRELLDVEEREYRLWHLLYSIEAKEETESALRKLKANKAFGDLNIDDAFVNSFLKIKPFEKEYGAYSEKAIKKLLAVMRRGSLWKEADICEATKQNIAKILQNDIDEKLKKKIEAAVSSFNKLSDFQGLPTWLACYVVYGRHSEAAQIQCWQSPEDLKTYINKFKQHSLRNPIVEQCLLETLRTVYDIWKDAGQIDEIHIELGRNMKSTAEQRARKTKDILRNENTNLRIKNLLVELKNDDKIENVRPYSPSQQEILRIYEEGALQELSKEDEMFEDISKISKMAQPSPTELSRYKLWLEQKYRSPYTGRVIPLSKLFTTAYQIEHIIPQSRYFDDSFNNKVICESEVNSLKDNMLGYEFIKECGGRIVHCTLLGDVKIFTKEEYKDFVTKHYIDNTYKRDKLLLEDIPQEFSARQLNDSRYISKMVQTVLSNIVRAENEQEATSKFVVSCNGAITNRLKKDWGLNDVWSSIVCPRFKRLNEITKTNAFGHWEDKAGKHVFQTTVPLELQRGFSKKRIDHRHHAMDALVIACASRNIVNYLNNESANSPEKREDLRKKLCDEKRKIRKPWKTFTQDAREALSDVVVSFKNYVRVINKATNYYEHYSSSGNKVMISQKGNDMWAIRKPLHKESVFGRVNLCRKVIVSLKKALENIPAICDKTLRDYINALVEKHFNTRQLLAHFKSINYRLNRQCVEKVEVWQFSDEKIEMVARRKSLDTSFDDKQISSITDTGIQKILLNYLQTKDGNAEIAFTPEGIEEMNKNISLYNDGKAHQPILKVRVATPKGMKYPVGQTGNKATKFVVAEKGTNLYFAIYENELGVRSYDTIPLNIVVERLKEGLSPVPQANEADIPLKFYLSPNDLVYVPTKENEDELCRDRIYKFVDSSGTTANFVPHTSANTIYNVDKEYAEKCCNGAVFLNEYGLGSPQSKNQRALTGEMIKEICWKLKVDRLGNIIKVIK

SEQ ID NO: 395 - protein, 1380 aa, Prevotella nigrescens
  Prevotella nigrescens F0103
MKRILGLDLGTTSIGWALVNEAESNNEASSIVRLGVRVNPLTVDEKSNFEKGKAITTNADRQLRHGARINLQRYKLRRQNLHDCLQKQGWLGTEAMYEEGKASTFETYKLRAKAAEEEISLHEFARVLFMLNKKRGYKSNRKANNKEDGQLFDGMTIAKKLYEEHLTPAEYSLQLLNKGKKFTQGYYRSDLNAELERIWDEQKKYYPEILTDEFKQQLEGKTKTNTSKIFLAKYGIYSADLKGLDRKLQPLKWRVEALKQQVDKEVLAFVISDLKGQIANTSGLLGAISDRSKELYFNKQTVGQYLWASLEENPHISIKNKPFYRQDYLDEFEKIWETQATFHKQLTPELKQEIRDIIIFYQRPLKSKKSLISVCELEQRKVKATIDGKEKEITIGPKVAPKSSPVFQEFRIWQNLNNVLLIDNDTNEKRPLDEDERYLLYKELSIKAKLSKTEALKILNKKGKQWDLNYKELEGNRTQAILFDCYNRIITLTGHEECDFKKIKASEIRHYVSTIFKNLGFSTEILDFDPSLEKHELEKQPMYQLWHLLYSYESDNSRTGNESLLRKLETTFGFPEEYATVLCDVVFEEDYGNLSVKAMRKILPYLQAGNDYSQACAYAGYNHSRHSLTKEELDQKVYKERLELLPKNSLRNPVVEKILNQMINVINAIIDEYGKPDEIRIEMARELKSSAADRKKTTHAINQGNDENQCIREILEKEFALSYISRNDIIKYKLYEELKPNGFKTLYSDTYIPKDKLFSKDFDIEHIIPKARLFDDSYSNKTLEARDINLAKSNKTAFDFVKEKYGEQGAEAYKKKLDMLLGNNVISKPKYNKLLMTEADIPSDFINRDLRNTQYIARKACEILGELVRTVTPTTGKITNRLREDWQLVDVMKELNFEKYEKLGLTEIVEDRDGRKIKRIKDWTKRNDHRHHAMDALAIAFTKPSYIQYLNNLNARSNKGDSIYAIENKELHYEEGKLRFNAPIPVNVFRAEAKRHLSAILVSIKAKNKVMTQNVNKIKTKHGIIKKIQLTPRGPLHNETIYGTKMRPIIKKVKVGAALDEATINKVSSPAIREVLLKRLNEYSGNAKKAFTGKNTLDKNPIYLNAERTKTVPASVKTVEWENYHPIRKPITPDLKVDKVIDKGIGEILKARLEEFNGDAKKAFSNLEENPIYLDQTKKIALKRVSIEGVLSTIPLHTLKNQAGKPIMGKDGKPVLGNYVQTSNNHHIAFYYDEDGNLQDNAVSFFEAAERKSQGISVIDKDYNRDKGWRFLFTMKQNEYFVFPNEATGFIPSEVDLTDEANYGIISPNLYRVQKMSRIEKGTSVSRDYWFRHHLETILNDDSRLKNSAFKRINSLKPLEGIIKVRINSIGKIVAVGEYD

SEQ ID NO: 396 - protein, 1391 aa, Prevotella oralis
  Prevotella oralis ATCC 33269
MKKILGLDLGTTSIGWALVNEKENNEELSSIIRLGVRVNPLTVDEKSNFEKGKDITTNADRTKCRSARRNLQRFKLRREALADCLKRHGLMTDETPLCETNNSIIFKTYSNRAKAVCEKIALDDFVRVLFMINKKRGYKSSRKLNTDDEGTLVDGMDVAKLLYNEQITPGEYLLRLFKKGKKTRPDFYLSDLKAELERIWDFQRTFYPEILCNALKEDLKGKSRTQSSAIFYAKYKVSTAKIAGKDKRLQELTWRTDALRKQLTIDEVAYVICSINGEVNGSSQRLSMISDRSKLLYFNHQTIGQYLMQRLEENPNAGLKNIIFYRQDYEDEFNDIWNSQATYHKELTPELKKEVKDIIFYQRGLKSCKWLINYCELEHEEIEVKTPEGKLRKITIGSKTCPKSSPLFQEFKIWQVLNNLQVSPLNSRRKAKRKKDEEPSLFSDEDMNTACRYLNEEEKLTLFKELSIKKELKKKDALKLLFENYKELDLNYKVISGNVTMANLYRAFQDIISLTGNGEFDFQAMPAEEAEKTVEEIFGGLGYKTAFLHFDASLHDKEFERQPAYRLWHLLYSYAGDQSKTGIEALVKRIQELCGFEPEYARILANISFIPDYGNLSSKAMRKILPYMQDGYEYSEACSKAGYRHSASSLTKEEINKKNYKTHLDEIKRNSLRNPIVEKILNQMVNVVNSVIDTYSNIDEIRIEMARELKKSKPEREDMSFAISKATKETERIKGILEQEFKIQHVTRNDIIRYRLYEELKPNGYKTLYSNTYIPREDLFSKKFDIEHIIPKARLFDDSYSNKTLELRDINIEKGNQTAYDFVLSKYGEEGLYKYEQRVEEFKKNNEQAGTKCRKLLMREADIPSDFLNRDLNDSQYIAKKAHELLREIVPTVTATTGSITNRLREDWKLVNVMKELNWEKYDKLGLTEEYKDKDGNTVRHIKDWTKRNDHRHHAMDALTIAFTKPSFIQYLNNLNARSNRGGSIYGIEQKELERENNKLVFIPPIDPKIFRKQAKEHLSNILISIKAKNKVVTKNVNKTKSKSGTNRKVQLTPRGQLHLETVYGKIRTYKTEEIKVGTKLTEELIAKVADKKIREALMQRLSEYGGNIKKAFQNISKHPIWLNGSHTKHVPEKVKIVFFEDVFTIRKAITPDIKIDKVIDSKIRRILQERLNEFGGEASKAFSNLDENPIWFNRDKGIAIKSVKIRGIAKGTAIRVKKDIHGKTIIGNNGYPVANDYVNTGNNHHVAIFRDKDGNLQEHIVSFYEATARAIQNLPIVDRNYNSEKDWKFLFSMKQNEYFVFPNPNTGFNPSEISLKDEKNYALISPNLFRVQKLSHYYYVFRHHLETNVDTNLQLKDITWKRITAVNNLTGAVKVRIDHLGRIVDVGEYK

SEQ ID NO: 397 - protein, 1204 aa, Prevotella ruminicola
MERILGIDTGTNSLGWAIVDKDENQYHLVAKGTNIFSEGVKIEKGIESSKAAERTEHRSVRKHYWRRKIRKIRLLTILSDNDLCPRLKHEQLRQWRLKKVYPTDDTFMEWQRTEDKAQVNPYKFRYICLTQKLDLSDITQRFILGRALYHLNQRRGFLSNRKEATKESEGTVKEGISSLSKDMKDSGCEYLGEYFYQLYQQGKKIRNHYTARKEHYLKEFKAICSKQELDDALIEKLEKAIFDQRPLKSQKGQVGTCTFEKGKSRCPSSHPLYEDFRMYSFINNIKVQVDTLYDKGERSLTDEEKQLIIPLFKRKSKRTFPFEDIAKKIAGKNNYCYIKSNEEKAYKFNYQMDTQVSGSPVNAQLEEIFGEDWLSSVCEVYTLANNKSRFQIMNDVWHVLFFYDDEDKLKEFAKDRLQLDDELAEKFSKISIPNDYAALSLKAIRKIMPYLRDYGLIYSEAVFLANLVDVLPQHVWGIKEMREAAIENVIDVMHSYDKNNIDGITLEGCVKTFLKERYQVSDDNLKKLYHPSMLDPYPRQRPNDEGVFQLGSPRISSVKNPMAMHSLFRLRKVVNLMLKKGYITPDTKVHIEFSRDLNDANKRWAIQTWQRENEKERERCRKEIEKYIASPSDTDILKYQLWEEQNHKCLYTGDEIRITDFLGDNPKYDIEHTIPRSAGGDSTKMNLTLCSSRFNRDEKKTKLPAELVNHDEILERISNWKEKYEDIDKQIRKISTKGATSKEDKDSKIRRRHYLILQRDYWRGKYQRFTMTEVPEGFSRRQGTDISVISRYARMYLKSVFKQVYIVKGIATSDFRKMWGIQDEYAKKERVNHVHHCIDAITIACIGKAEYDKLADYRHQYDDYLFQGKTKPTFDKPWPSFVIDIKHIQDELLIAHYAKDNLEKFTKKNLRGKDGRIIRDKFGNKLQMKGDTSRNSLHNDKFYGAINHEGEIKYVYRTNIEALDAKSIGNIVDPTVRSIIESAIAIHGSLKAAINKGIWMNEEKHIPIKKVRVFRNDVKKPIELKDQRDLSDKDYKQHYYVTNDGNYMMLIFSKLNNKGREIRQHVVINSLEATEVIKSHKRSQVGKVVWESYYSKEGFDLIYKLKSGTMILLYENNRDEVWDLDIRNLQKRLYIITKMKYDGRIYMMHHQEAREKKDLEEKSGSFKINEDYRPLIVNSYNQFNALVQDLDFEINDLGEIRRLI

SEQ ID NO: 398 - protein, 1424 aa, Prevotella sp.
  Prevotella sp. C561
MTQKVLGLDLGTNSIGSAVRNLDLSDDLQWQLEFFSSDIFRSSVNKESNGREYSLAAQRSAHRRSRGLNEVRRRRLWATLNLLIKHGFCPMSSESLMRWCTYDKRKGLFREYPIDDKDFNAWILLDFNGDGRPDYSSPYQLRRELVTRQFDFEQPIERYKLGRALYHIAQHRGFKSSKGETLSQQETNSKPSSTDEIPDVAGAMKASEEKLSKGLSTYMKEHNLLTVGAAFAQLEDEGVRVRNNNDYRAIRSQFQHEIETIFKFQQGLSVESELYERLISEKKNVGTIFYKRPLRSQRGNVGKCTLERSKPRCAIGHPLFEKFRAWTLINNIKVRMSVDTLDEQLPMKLRLDLYNECFLAFVRTEFKFEDIRKYLEKRLGIHFSYNDKTINYKDSTSVAGCPITARFRKMLGEEWESFRVEGQKERQAHSKNNISFHRVSYSIEDIWHFCYDAEEPEAVLAFAQETLRLERKKAEELVRIWSAMPQGYAMLSQKAIRNINKILMLGLKYSDAVILAKVPELVDVSDEELLSIAKDYYLVEAQVNYDKRINSIVNGLIAKYKSVSEEYRFADHNYEYLLDESDEKDIIRQIENSLGARRWSLMDANEQTDILQKVRDRYQDFFRSHERKFVESPKLGESFENYLTKKFPMVEREQWKKLYHPSQITIYRPVSVGKDRSVLRLGNPDIGAIKNPTVLRVLNTLRRRVNQLLDDGVISPDETRVVVETARELNDANRKWALDTYNRIRHDENEKIKKILEEFYPKRDGISTDDIDKARYVIDQREVDYFTGSKTYNKDIKKYKFWLEQGGQCMYTGRTINLSNLFDPNAFDIEHTIPESLSFDSSDMNLTLCDAHYNRFIKKNHIPTDMPNYDKAITIDGKEYPAITSQLQRWVERVERLNRNVEYWKGQARRAQNKDRKDQCMREMHLWKMELEYWKKKLERFTVTEVTDGFKNSQLVDTRVITRHAVLYLKSIFPHVDVQRGDVTAKFRKILGIQSVDEKKDRSLHSHHAIDATTLTIIPVSAKRDRMLELFAKIEEINKMLSFSGSEDRTGLIQELEGLKNKLQMEVKVCRIGHNVSEIGTFINDNIIVNHHIKNQALTPVRRRLRKKGYIVGGVDNPRWQTGDALRGEIHKASYYGAITQFAKDDEGKVLMKEGRPQVNPTIKFVIRRELKYKKSAADSGFASWDDLGKAIVDKELFALMKGQFPAETSFKDACEQGIYMIKKGKNGMPDIKLHHIRHVRCEAPQSGLKIKEQTYKSEKEYKRYFYAAVGDLYAMCCYTNGKIREFRIYSLYDVSCHRKSDIEDIPEFITDKKGNRLMLDYKLRTGDMILLYKDNPAELYDLDNVNLSRRLYKINRFESQSNLVLMTHHLSTSKERGRSLGKTVDYQNLPESIRSSVKSLNFLIMGENRDFVIKNGKIIFNHR

SEQ ID NO: 399 - protein, 1483 aa, Prevotella sp.
  Prevotella sp. MSX73
MKTILGLDLGTNSIGWAKVSVDDYGNYLHDIKLGSRIIPMSQDVLGNFDSGVTVSQTAQRTEFRSKRRLVQRNLQRRERLHRVLHVLDFLPAHYDAAIGWDRTEAVTYGKFLNHAEPKLAWEELGNGKRRFLFMDSFHEMVADFARCQPALVADGKKIPLDWTIYYLRKKALTQAITKEELAWILLNFNQKRGYYQLRGEEEEENPTKQEEYYELKVVSVEATDSRKGNDTWYNVHLENGWIYRRSSKISLDDWVGKVKQFIVTTEYEKDGTTLKTDKEGNVKRSFRAPNENDWGLRKKRTETLLEMSGKTVGAFIYDHLLQEPADKIRGNFIRTIERHYYKAELEAILAEQCKYHIELRDKEMLEACARELYLNNLPHQRSLMKKDMTYLLLYDLIFYQRPLKSKKALIANCPYEYYEYVDKETGEIKRQNIKCIAKSNPYFQEFRLWQFVLNLRLFDRVEDKEVTANYLPTADDHARLFTYLNDRKEINQETLLKDYFKLKKVKIGNEKEYPIRWNYIEDKEKKYPCNETRYELLMALDRAGIEHKWLDDNNLEYRLWHLLYSVEVKSESETALRKLKNDDAFVNSFLKVKPFKKEYGAYSEKAIKRLLAVMRKGFLWNEQDICDETRKRIEIIIKGDVDEKVKERMGHAAYSFDRVSDFQGLPEWLACYVVYGRHSEAMDIQRWDSPERLMAYINNFKQYSLRNPIVEQCILETLRTVHDIWKETGQIDEIHVELGREMKSTSEERARRTQNVLRNENTNLRIKSLLIELKNDTDICNVHPYSPMQQEILRIYEEGALQELNREDEDFEEISKISQMSQPSGKELNRYKLWLEQKYRSPYTGKAISLAKLFTPAYQIEHVIPQSRYFDDSFTNKVICEAEVNTLKSNLLGYEFIKKHGGEIIHCTTLGDVRIFSESEYKAFVMDHYANNKSKKDKLLMEDIPQEFLSRQMNDSRYISKVVKTLLSNIVRMADESEATSKSVIVCTGGVTDRLKKDWGLNDVWNSIVYSRFERLNRLTGTEAFGHWENKDGKRVFQTSMPLELQRGFRKKRIDHRHHAMDALVIACASRNIVNYLNNESANNPKKREDLRRQLCDKNRVIRKPWETFTQDAYNALENVVVSFKNYVRVINKATNRYEHYDENGKKRFVQQKGSELWAIRKPMHKETYYGHVNLRRKELVTLQKALDDIPSICDKKLRDYISALVEKHFNKRQLLAHFKSTDYYWQKQYVNKVYVWTFSDDIKPLVATRKLLDTSFDAKRIGTITDTGIQKILRNYLEAKGGNATLAFTPEGIVEMNQNISKYNDGKPHQPILKVRITEPMGAKYRVGQTENKMAKYVEAQSGTNLYFAIYEDSEGKRSYTTVPLDEVAERLKQRLSPVPEKDENDVPLKFYLSPNDLVYVPTEEELQLRECKLNKDRIYKMVSSTGSECHFIPYYVANVIYNKVEFEAKNKIGRALTGEMIKAVCWKLEIDRLGNILKVIK

SEQ ID NO: 400 - protein, 1375 aa, Prevotella sp.
  Prevotella sp. oral taxon 306 str. F0472
MKKILGLDLGTTSIGWALVNESENKDEQSSIVRLGVRVIPLTVDEKGNFEKGKAITTNADRQQVHAARINLQRYKLRRENLRDCLQKQGWIGSEPMCEDGKSSTFETYKLRAKAAVEEVSLHEFARVLFMLNKKRGYKSNRKANDKEEGKLFDGMTIAKKLYEEHLTPAEYSLQLLNTGRKFTPEYYRSDLIEEFEKIWNEQQKYYPEILTDEFKQQLEGKAKSNTSKLFLGKYGIYSADTKGLDRRLQPLKWRVEAMKQQVDKDVLAFVISDLKGQIANTSGLLGAISDRSKELYFSKQTIGQYLWASLQENPHISIKNQPFYRQDYLDEFEKIWETQATYHKELTSELKQEIRDIIIFYQRPLKSKKNLIAVCELEQRKVKVTVDGKEKEITIGPKIAPKSSPMFQEFRIWQNLNNILLLDHETNSKRPLYEEERNLLYEELSVKEKLSKTEALKVLGKKSKQWDLNYKELEGNRTQAVLYDCYNRIIVMSGHEECNFKKLKASDIRHYVKMIFKNLAFNTDILCFDSSLKGHELERQPMCQLWHLLYSYEGDNSRTGNDALLRKLETSFGFPKEYAAVLADVIFEDSYGNLSVKAMRNILPHLQAGKDYSQACEEAGYKHSRRSLTKEELNQKVYKEKLELLPKNSLHNPVVEKILNQMVNVINAVIEEYGKPDEIRIELARDLKIGAAERENMTRSINQGNAENKRIREILEKEFALSYLSRNDIIKYKLYEELKSNGFKTLYSDTYISKDKLFSKDFDIEHIIPKARLFDDSLSNKTIEARDVNIAKSNKTAFDFILERYGEQGVKTYKTKLLRLLEDGAISNKKYNNLLKTEADIPSGFIDRDLRNTQYIAKKAYEILSELVKIVTPTTGSVTNRLREDWQLVDVMKELNFEKYQKLGLADVIEDRDGRKVKRIKDWTKRNDHRHHAMDALTIAFTKPSYIQYLNNLNARSDKSSSIYGIEVKELHREEGKFRFNAPLPINEFRAEAKRHLKSVLVSIKAKKKVMTQNVNKIKTKHGIIKKVQLTPRGELHNATYYGTKKRPLVRMVKVGAALDEATIKRVCSPAIRAALLKRLNAYNGDAKEAFTGRNSIDKNPIYLDIEQTKLVPVLVKTIEWGMYHPIRKRITPDLKIDKVIDKGIREKLKARLAEFNGDAQKAFSNLDENPIYMDEAKRITLKRVSIEGVLSAIPLHTLKDKAGKPVIGSDGKPVFGDYVQTSNNHHIAFYIDDKGNLQDNPVSFFEAAERKSQGVPVIDRRYNCDKGWHFVFTMKQNEYFVFPNEATGFIPSEVDLLDEANYCIISPNLYRVQKLSKASGRDYWFRHHLETMLNDDLRLKNSTFKRIQSLKGLEDIVKVRINSIGKIVAVGKYD

SEQ ID NO: 401 - protein, 1216 aa, Prevotella stercorea
  Prevotella stercorea DSM 18206
MTKILGIDTGTNSLGWAIVDKTADNYNLLDKGVNIFQEGVKIEKGIESSKAAERTEHRATRVRYYRIKLRKIRLLRILSDNHLCPPLSQEELSTWRLKKVYPKNELFMQWQRTDDDTEKTPYAYRHKCIHEKLDLSDVTDRYILGRAFYHIIQRRGFLSNRKEQGGEDSGKVKEGISTLTHEMNEAGYEYLGDYFYALYNKGEKIRKHYTARNEHFLSEFKAICEKQDLEKELGSEVVRNIEKAIFDQRPLKSQKGQVGKCVFEKNKTKCPSSHPMYEEFRMLTFINNIKIKTPNDDVLRPLNTGEREKIMPLFFRKSKKQFDFEDITKKLAPKKMYGFYKKEEDAEMPFLFNYPMDTSVSGCPVTAALKDVFGDDWITAICETYTLGEGKSRFDIVNDIWHALYFYSDKDKLAEFAINRLQLSEDEAKIFSEISLPADYASLSLKAICKILPYLRRGLIYSHAVFLGNLCEVMPKYEWSIKEMRETIIDNIIMEMDKCDTKDKRTFEVCIKDYLKGQYNVSDNSLKKLYHPSMIETYPRVQYTNEHGVYQLGSPRIDSVRNPMAMRSMFRLRKLVNRLLVEGKIDQNTEVHIEFARELNDANKRNAIALFVKENQSANDEARKQIITLFKKETGTDIEPTDKDILKYVLWEEQNHICLYTGKQIRISDFIGANPKFDIEHTIPRSVGGDSTKMNLTLCDSRFNREVKKTKLPVELPNHDEIMERIKEWKKNYELLDIQIRKNKKLSKGATTKEQKDTIIRKRHLLELRRDYWRGKYERFTMESVPEGFSRRQGTDISVISKYARLYLKSLFNRVYTVKGIATSDFRKIWGIQDIYSKKERINHVHHCIDAIVIACIGLDEYNKLGAYYHDEENNKWYGMSKASFKKPWATFVEDIKKIQDEILVYHYTPDNMPKQGRRRIKIDGKKILCKGDAARGSLHNDTYYGAIENDGAVKYVKRIDLASLEEKDVKNIVDDTVRSIIEAAIKEKGFKDAMASTIWMNEEKRVPIKKVRCFTPSITKPLNIRKQRDVSIKEYKQQYHVANDSNYLLALYIGTDNKGKEKREFEIVNILQAAQYYRTSNDKEVVDRHIVPIKSEHDYPFAYTLKIGTMVLLYEKSPNEVWDATIKERNRRLYKVTGLSTMRMKGRNGEYAYATVKLIHNEEARPSKDIKAKNGEYEQGEEFRPAIIMLHTQLNALVQGYDFEINELGEIRRLR

SEQ ID NO: 402 - protein, 1234 aa, Prevotella tannerae
  Prevotella tannerae ATCC 51259
MPNFWSIFTENLQTYLMKTRILGLDTGTNSLGWAVVDRDENNQYTPICRGDLIFTEGVKQEKGIEFSLAAERTSYRASRRHYFRRRLRKVEVLKVLVKHKLCPPLSDEALNRWHTKKEYPLDEDFILWQRTNEADNKNPYHDRHICLHRKLNLKDSQTDRYTLGRALYHLTQRRGFLSNRLDQNEEAEETGKVKSAISELSKEMKEAGCEFLGDYFYLLYRTEGNRVRIRSRYTDREKHYLQEFKEICRVQELDEDLAKALEKTIFFQRPLKSQRQGVGKCTMEKGHSRCAVSHPLYEEYRLLCYLNNIRIKTPSDDRLRPLNAEEREKITPLFYKEKNFDFEKIAKKLAGKTPFGWIRDAEDWPYQFNYRMTQEAPACPTTAQLIKVFGEDWKAALAETYTMSAKQDGTLKTEDEICTDIWNVLYSFSSKEKLKEFGLKKLQLDEVQAKAFSEIRLTRDFASLSLKAIRKILFFLRTGEDYSKAIFLANIPTIVGEEIWNDIERRSRLLYKVDLALRPQEERDAEEHRTIAERIKAAVAAEVPDAPIDLLYHPSMIEAYPDAKRNERFDCYQLGSPKTNAVRNPMAMRSLHMVRKVINHLLRKHIIDEKTEIHIEYARELNDANKRQAIADWQRELSKRHTAYAQNIRQLYKAETGLVIEPTKADILKYQLWEEQQHVCLYTGKKIGIADFLGANPKFDIEHTIPRSRGGDSTQENLTLCESKFNRDIKRDKLPTELANYEEILARIEHWKKQCYALKLKRDGIRTHSGLEKSIKDSRIRRRHLVGLEYGYLKGKYDRFTMKEVPEGFSRRQGAGIGLISKYAGLFLKSLFKDPKNPNRSNVYVVKGAITAEFRKLWGLQQADEAKSRENHTHHCIDAYTIACIGPCEYAALAAYYRSDEEFKYGRRREKPQFEKPWPTFTEDLLKLQEELLIVHQTTDKLGKRDRRKVKTPRGKFLTGGDSARGRLHQETYYGAINYDGNIKYVVRKPLDSLTEKDLDKIVDETVMGIVKGAVEAKGSLKEALADGIYMNKEKGILIKRVRIFSDVSEPINLKQLRDVSTKEYKRHIHLRKDENYLFAIYEGIDKKKNKKQTETATVDYLDAAKFYKDSKRRDKANSLVGDYSKKNKLPLKCILKKRQMVLFYEHSPEEIRFKDKKDLSRRLYIVTSIAKDGRVKFLHHQAATATGIQSSPSPFTNDGEHQPYYRLSASNIKVLVAGIDFDINILGEITPKL

SEQ ID NO: 403 - protein, 1487 aa, Prevotella timonensis
  Prevotella timonensis CRIS 5C-B1
MKNILGLDLGSNSVGWALVKVEENGNPIGSIKMGSRIIPMSQDILGSFEKGDTVSQTAQRTLYRGKRRLIERHVLRRERLCRVLHIMNFLPAHFDRLLGWDKTDNKTYGKFIDDSEPKLAWRQNKNEMGKMEFVFMDSFHEMLSDFAKHQPQLIANGKKVPLDWTIYYLRKKALTQLISKEELAWILLNFNKKRGYYQLRGEEEEEQPTKKEEYKVLKVISVDADEGQKGNGIWYNIHLEDGGIYKKKSDIPLYDWVGKTLQLIVVTTYEKDGKTPKIFDSGKQNPSYRLPKEDDWGLVKKRTESQLQSSGKTVGAFIYDNILSKPDDKIRGNLVRTIERKYYKKELIEILQQQAKYHDELHNQNLLESCAKELYAHNDVHYNEVIKSNMINLLVNDIIFYQRPLKSKKSLIANCKYESYEYVDKETGEIKEMPIKCIAKSNPYYQEFRLWQFIHNLRLSDVVTREDVTAQYLSTPQDYCNLFTYLNDRKEIKQDILLKDFFKIKKVQIDKEKVFPIEWNYIKDATKSYPCNETRYELLSALKRAGMDKQWLDDTPNMQYRLWHLLYSVEEKEESAKALRKLYDDDKFVTSFLKIKPFNKCYGAYSEKAIKRLLTLMRMGKAWNEQAIDAKTLKCIQQIITDNVDSKLKEKIDDSRYVLHHVSDFQGLPTYLASYVIYGRHSEVTDIQCWDSPEDLLKFIRDFKQHSLRNPIVEQVILETLRVVYDIWKAEKHIDEIHVEVAREMKLTAQQRNEANLRNLNNEATNLRIKYLLEELKNDTFIKDVRPLSPIHQEKMRIYEQAVLGNLNKQDKDYDDIIKISKKEHPTNAELIRYKLWLEQRYCSPYTGKAISLSKLFTTAYEIEHIIPQSRYFDNSFNNKVICEAEVNKAKGNMLGYEFIKKQGGQKIYCTQLGKAVTILKEEAYKQFVNEHYAHNKRKRDNLLAENIPESFSSRQLNDTRYITKTIMSLLSNVVRQQSEEEATAKNLLPSSGSVTDRLKNDWGLKDVWNTIVTPRFERLNKLSGTNDFGEMKEENGNRYFQTNVPLEYEKGFKKKRIDHRHHAMDALVIACTTRNMVNYISNANANSPKQREDLRQLLCDKNRIINKPWDTFTQDALKALNDIVVSFKNNVRIINRATNRYQRYDKNGKKIIFSQKGDDMWAIRKSMHKETVFGRVNLIRKEVLPIAKALDNISAICNAQLRAYVNDLVDKHFNKKQLVAHFKSLNYKWNRQDVSKVEVWISSDNKTPMVAVRKPLDTSFDKKKIASITDTGIQTILLNYLESKGGDASVAFAPEGIQEMNSNIELYNNGKAHKPIKNVRLSEPLGAKYQVGERGAKTKKYVEADKGTNLFFAIYEDEEGKRYYYSVPLREAIERQKQKLSPVPEYNEKGVALKFYLSPNDLVYVPTEEERTMGTCHIDKARIYKMVSSTGCSCYFVPSTFAKVIVDKVELQSLNKMEKAITDECIKEVCWKLKVDRLGNIINVIK

SEQ ID NO: 404 - protein, 1218 aa, Prevotella timonensis
  Prevotella timonensis CRIS 5C-B1
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYDAQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTIAQLKSIFGDDWKTGIAETYTLIQKKNGSKSLQEMVDDVWNVLYSFSSVEKLKEFAHHKLQLDEESAEKFAKIKLSHSFAALSLKAIRKFLPFLRKGMYYTHASFFANIPTIVGKEIWNKEQNRKYIMENVGELVFNYQPKHREVQGTIEMLIKDFLANNFELPAGATDKLYHPSMIETYPNAQRNEFGILQLGSPRTNAIRNPMAMRSLHILRRVVNQLLKESIIDENTEVHVEYARELNDANKRRAIADRQKEQDKQHKKYGDEIRKLYKEETGKDIEPTQTDVLKFQLWEEQNHHCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFKQGRGSKPKFSKPWATFTEDVLNIYKNLLVVHDTPNNMPKHTKKYVQTSIGKVLAQGDTARGSLHLDTYYGAIERDGEIRYVVRRPLSSFTKPEELENIVDETVKRTIKEAIADKNFKQAIAEPIYMNEEKGILIKKVRCFAKSVKQPINIRQHRDLSKKEYKQQYHVMNENNYLLAIYEGLVKNKVVREFEIVSYIEAAKYYKRSQDRNIFSSIVPTHSTKYGLPLKTKLLMGQLVLMFEENPDEIQVDNTKDLVKRLYKVVGIEKDGRIKFKYHQEARKEGLPIFSTPYKNNDDYAPIFRQSINNINILVDGIDFTIDILGKVTLKE

SEQ ID NO: 405 - protein, 1496 aa, Prevotella veroralis
  Prevotella veroralis F0319
MKTILGLDLGTNSIGWAKVCVDDNGNYLRDIKLGSRIIPMSQDVLGNFDKGVTESQTSVRTGFRGVRRIRERSLLRRERLHRVLHVLGYLPPHYDSAIGWNKNEPSTYGKFLNHGEPKLAWEHKEDGSMRFLFMESFHEMMADFAKSQPSLVSDGKKIPLDWTIYYLRKKALSQPIRKEELAWLLLNFNQKRGYYQLRGEEDDDNPTKCEEYYELKVVGIEADEEGKNGNTWYNVKLENGWIYRRQSKIPLDDWIGKVREFIVTTEYEKDGITLKKDKNGDVKRSFRSPSEDDWGLRKKRTEKLLDSSKMTVGAFVYDHLLAEPSDKIRGKFIRTIERKYYKKELYAILCEQSKYHEELRSGDYLNKCAEELYKNNQPHRNSLLTKDLAYLLLEDLIFYQRPLKTKKSLIAECPYEAYKYVDKETGEIKRQGIKCIAKSNPYYQEFRLWQFISNLRLFNKADDKEVTADYLPTQDDYVRLFAYLNDRKEINQETLLKEFFKLKKITVNSEKVFPIRWNYIEDKEKKYPCNETRHELLLALDRARIDHSWLEKPGQEYRLWHLLYSVESKEETKEALRKLKDDDAFVESFLKVKPFKREYGAYSEKAIKKLLAVMRMGSLWRETDICDTTKGNITKILQGEIDEKLKEKISASVSSYNQLSDFQGLPVWLACYVVYGRHSEAAEIQHWKTPESLLAYINGFKQHSLRNPIVEQCILETLRTVHDIWKEVGHIDEIHVELGRNMKSTADQRARISENVLRNENTNLRIKSLLLELKNDPNIKDVRPYSPMQQEKLRIYEEGVLQELTKDDKDFTEITKISTMAQPSAKELQRYKLWLEQKYRSPYTGKSISLTKLFTSAYQIEHVIPQSRYFDDSFSNKVICESEVNSLKDNMLGYEFIKNHGGEIIHCTMLGDVKVLSESEYKAFVNDHYAHNKRKRENLLLEDIPQEFLNRQMNDSRYISKVVKALLSNIVRAEGEEEATSKFVVSCSGGITDRLKKDWGLNDVWNKIVYPRFERLNRLTGTEAFGQWENKDGKRVFQTAVPLELQRGFNKKRIDHRHHAMDALVIACTSRNIINYLNNESANNPKKREDLRQKLCDKNRTIRKPWETFTQDATAALEDVIVSFKNYVRIINKATNYYERYDVEGKKVIAEQRGDDMWAIRKPMHEATYYGRVNLRRKKKVNLRVALENISSICDNKLRIYINGLVEKGFNTKQILDKFKNTNDHFSMQKIDKVEIWQFTNEEEKLVATRKPLDTSFDTKKIASITDTGIQTILLNYLETKGGDSTIAFTPEGIVEMNQNISKYNNGKEHMPILKVRLYTKLGKKIPVGQTGCKAKQFVIAEAGTNLYFAIYEDEEGKRSYRTIPLNEVVERLKQGLSPVPEKNDKDVHLKFYLSPNDLVYVPIEDEHESLAKDHIYKFVDSSGTTANFIPHRSANVIFELNKKDAEKFCSGSIIQNEYGVGSSQSKNQKAITGEMIKAVCRKLEVDRLGNVIKVI

SEQ ID NO: 406 - protein, 1062 aa, Ralstonia syzygii
  Ralstonia syzygii R24
MAEKQHRWGLDIGTNSIGWAVIALIEGRPAGLVATGSRIFSDGRNPKDGSSLAVERRGPRQMRRRRDRYLRRRDRFMQALINVGLMPGDAAARKALVTENPYVLRQRGLDQALTLPEFGRALFHLNQRRGFQSNRKTDRATAKESGKVKNAIAAFRAGMGNARTVGEALARRLEDGRPVRARMVGQGKDEHYELYIAREWIAQEFDALWASQQRFHAEVLADAARDRLRAILLFQRKLLPVPVGKCFLEPNQPRVAAALPSAQRFRLMQELNHLRVMTLADKRERPLSFQERNDLLAQLVARPKCGFDMLRKIVFGANKEAYRFTIESERRKELKGCDTAAKLAKVNALGTRWQALSLDEQDRLVCLLLDGENDAVLADALREHYGLTDAQIDTLLGLSFEDGHMRLGRSALLRVLDALESGRDEQGLPLSYDKAVVAAGYPAHTADLENGERDALPYYGELLWRYTQDAPTAKNDAERKFGKIANPTVHIGLNQLRKLVNALIQRYGKPAQIVVELARNLKAGLEEKERIKKQQTANLERNERIRQKLQDAGVPDNRENRLRMRLFEELGQGNGLGTPCIYSGRQISLQRLFSNDVQVDHILPFSKTLDDSFANKVLAQHDANRYKGNRGPFEAFGANRDGYAWDDIRARAAVLPRNKRNRFAETAMQDWLHNETDFLARQLTDTAYLSRVARQYLTAICSKDDVYVSPGRLTAMLRAKWGLNRVLDGVMEEQGRPAVKNRDDHRHHAIDAVVIGATDRAMLQQVATLAARAREQDAERLIGDMPTPWPNFLEDVRAAVARCVVSHKPDHGPEGGLHNDTAYGIVAGPFEDGRYRVRHRVSLFDLKPGDLSNVRCDAPLQAELEPIFEQDDARAREVALTALAERYRQRKVWLEELMSVLPIRPRGEDGKTLPDSAPYKAYKGDSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 407 - protein, 1066 aa, Rhodopseudomonas palustris
MSERVVRRILGIDLGIASCGWGVVDISGAGGGIIATGVRCFDAPLIDKTGEPKSATRRTARGQRRIVRRRRQRMNGVRRLLCEFGLLPDPRPDALNQAMRRISTASAAAQVTPWTLRAAAHQRLLSNEELAVVLGHIARHRGFRSNAKNEAGANAADETSKMKKAMEATREGLAKYHAFGDMIANDPKFANRKRNRDKDYSHTAKRSDLEDEVRAILRAQLRFGSAAATETLAQTFADVAFFQRPLQDSEDRVGDCPFEPGQKRAARRAPSFELFRFLSRLANLKLAVGRSPERRLTAEEIALAAKGFGETKKTITFKSLREALDLDPNARFSGIGKDKEASLDVVARTGGAAYGTKTLKDALGDAPWRSLSRTPETLDRIAEILSFREDITSIRNGLEDLGLDSLVVEALMQAAANGDFKEFTRAGHISARAARNIIPGLREGLVYSEACARVGYDHAARLSVPLDQVGSPVTRKALSEALKQVRAVAREYGPIDYFHIELARSVGKSAEERKQLTDGIEARNVEKAKRRKQAEEHLGRAPSDDELLRYELAKEQNFKCIYSGDAIDPAGVAANDTRYQVDHILPWSRFGDDSYLNKTLCTARSNQNKRGRTPFEWFEADKTDVEWMEYVARVENLQEVKGRKKRNYSIKDAAAIEDKFKARNLTDTQWATRLLADELSRMFPPRECERAICGRADGGNDGLTIVEERRVFTRPGAITSKLRRAWGLEGLKKQDGKRVEDDRHHAVDALVLAATTESLLQRLTVEVQRREREGRPDDIFHCAEPWRGFRADVRRTVYGSETMPGIFVSRAERRRARGKAHDATIKQIREIEGERLVFERKPVEKLTDKDLEKIPIPKPYGQVSDPKRLRDELVESLRAWIAAGKPKDRPPLSPKGDVIRKVRIQTNDKVSVEINGGTVDRGDMARVDVFRKKNKKAVWEYYVVPIYPHQIVALNDPPDRAVIAYAEDKDWKEIDSSYEFLWSLFGLSYVEISKANGECIDGYFRGLHRGTGAASVCKHISLGKDATVSGIGLKTLASFKKFTIDRLGRKFEIPREVRTWRGEACT

SEQ ID NO: 408 - protein, 1064 aa, Rhodopseudomonas palustris
MSECVTRRILGIDLGIASCGWGVIEVGEASGSIIASGVRCFDAPLIDKTGEPKSATRRTARGQRRIIRRRRQRMNAVRRLLAEFGVLTGRSPDALHQALLRLSQSVAGSQVTPWTLRAAAHERKLTNDELAVVLGHIARHRGFRSNSKNDGGANAADETSKMKKAMETTREGLARYHSFGAMIASDPKFADRKRNRDKDYSHTAKRSDLEDEVRTIFRSQTRFGSLVASEKLSQAFADAAFFQRPLQDSEDMVGSCPFEPGQKRTARRAPSFELFRFLSRLANLKLTVGRAPERRLTPDEIALAAKGFGETKKSITFKSLREALDLDPNARFSGVAKEKESTLDVAARTGGAAYGTKTLKDALGDAPWRSLSRMPEKLDRIAEILSFREDMKAIRNGLEEVGLDGLVVDALMQATANGDFKDFTRAAHISALAARNIIPGLREGLVYSDACTRVGYDHAARPAVPLSQIGSPVTRKALSEALKQVRAVAREYGPIDYFHIELARSIGKSAEERKKLTDGIEARNVEKEKRRKEAAEHLGRAPSDDELLRYELAKEQNFKCIYSGDPIDPAGISANDTRYQVDHILPWSRFGDDSYVNKTLCTARSNQNKRGRTPFEWFDADKTEAEWMEYSARVEDLKEVKGRKKRNYSIKDAASVEDKFKARNLTDTQWATRLLADELKRMFPPRECERVVTVRADGGNDGLSIVEERRVFTRPGAITSKLRRAWGLEGLKKQDGKRVEDDRHHAVDALVLAATTESLLNRLTVEVQQREREGRQDDIFHCSQPWPGFRVDVQRTVYGSETMPGIFVSRAERRRARGKAHDATVKQIRDIDGERIVFERKPIEKLTDKDLERIPVPEPYGKAADPKKLRDELVENLRAWIAAGKPKDKPPRSPKGDIIRKVRIETKDKVAVEINGGTVDRGDMARVDVFRKKNKKGVWEFYVIPIYPHQIVASALPPNRAVIAYKAESEWTAIDGCFEFAWSLNPMSYLELVKSNGELIEGYFRSMDRTTGAINLSPMSTNSETIRSIGVKTLSSFRKFTVDRLGRKFEIPREVRTWRGEACT

SEQ ID NO: 409 - protein, 1173 aa, Rhodospirillum rubrum
  Rhodospirillum rubrum ATCC 11170
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 410 - protein, 1059 aa, Rhodovulum sp.
  Rhodovulum sp. PH10
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 411 - protein, 1405 aa, Riemerella anatipestifer
MKTILGLDLGTNSIGWALVKEAENSNEKSEIIKLGVRVNPLTVDEKTNFEAGRPLSTNADRTAKRSARRNLQRYKLRRKNLIDLLIKNQLIDKDTPLTEIGKNTTHQTLELRAKAARERIELEDLARVFLAINKKRGYRSSRKVNNEEEGQAVDGMAVAKKLYDENLTPGQYAYELLSKGKKYVPDFYRSDLQAEFNAIWEYQKQFYADILDDELYNALKGQGQQNSRKRFLAIKGVYTAENKGKRDDVKLRHYKWRSEAISKKINIEEVAYVLVEINNDLNKSSGYLGAISDRSKELYFNKETVGENLWKQIQKNPHTSLKNQVFYRQDYLDEFEQIWETQAQFHPQLTLALKEQIRDVIIFYQRKLKSQKGLLSFCQFESWEIERKDENGNVILNKTTQLPKRQTVGRRVAPKSSPLFQEFKIWQNINNLEVTKISEGASKNKKETETLSDDERKLLFEELNLRGNLSQKEVLQILGLKDKEYKTNFSEGLEGNRTNAALFNIYQQIAENEGYGFDWSKKSAQEIKEELKAVFPQIGIQADILDFNANLDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRELLDKLELLPKNSLRNPVVEKILNQMVNVVNQVIETYGKPDEVRIELARELKKSAEKRAEMTKSINEATRRNEDIKKLITKDFGIPNPTKSDVVRYRLWEELAPLAYKDVFTGKQIKKEDLFSSKIDIEHIIPKALLFDDSFSNKTLVFRETNLKKADRTAYDFIESDYNATLDDYIQRVETLYNNTKGTISKGKRNKLLMAQKNLPDGFIERDLRNSQYIAKKAKAMLYQVFKDVNVTSGSITDRLREDWDLINVMKELNFPKYKALGLTEIEERYDIGQEKTKRVEVITDWTKRNDHRHHAMNALTVAFTTSSHIQYLNYLNARKNESHKEHKNIKGIENKITHKQKDKRKFIPPMPNFREEAKKHIETILVSIKNKNKVYTKNINKTKKKSGHNTKEQLTPRGQLHKETVYGKSKRPMSKPTKINKNFSLEQAQLIINVQEKELVLRHLAQFDNNPAVAFDTKTLKKMPLLKNGEPLKEVLCFEEIFTIRKDITPDLKIEKVVDEKIKAILEQRKKDFGGNAKEAFSDLDKNPIWLNKKKGICIKRVTITGVSNAEALHHQKDHLGREILDDNGNPIPADFVSTGNNHHLAVYLDSEGKLQDNIVSFYEAVVRTSQGLPVVDKGLNKDLGWKFLFSLKQNEMFVFPNDDFDINDFDLLDDKKAELISKHLYRVQKISKVSAGNSFVRDIVFRHHLETTVKEVKELKDISYIQLKSLEGLRNIKKVRINHIGKIVQVGEY

SEQ ID NO: 412 - protein, 1400 aa, Riemerella anatipestifer
MKTILGLDLGTNSIGWALVKETENSNEKSEIIKLGVRVNPLTVDEKTNFEAGRPLSTNADRTAKRSARRNLQRYKLRRKNLIDLLIKHRLIDKDTPLTEIGKNTTHQTLELRAKAARERIELEDLARVFLAINKKRGYRSSRKVNNEEEGQVVDGMAVAKKLYDENLTPGQYAYELLSKGKKYVPDFYRSDLQAEFDSIWEYQKQFYADILDDELYNALKGQGQQNSRKRFLAIKGVYTAENKGKRDEVKLQHYKWRSEAITQKLSIEEVAYVLVEINNDLNKSSGYLGAISDRSKELYFNKETVGENLWKQIQKNPHTSLKNQVFYRQDYLDEFEQIWETQAQFHPQLTLALKEQIRDVVIFYQRKLKSQKGLLSFCQFESWEIERKDENGNVILNKTTQLPKRQTVGRRVAPKSSPLFQEFKIWQNINNLEIAKISDGNSKNKKETEALSDDERKLLFEELNLRGNLSQKEVLQILGLKDKEYKTNFPEGLEGNRTNAALFNIYQQIAENEGYGDWTKKSAQEIKEELKAVFPQIGIQADILDFNAELDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRERLNKLELLPKNSLRNPVVEKILNQMVNVVNQVIETYGKPDEVRIELARELKKSAEERAEMTKGINEATRRNEDIKKLITKNFGIPNPTKNDVVRYRLWEELAPLAYKDVFTGRQIKKEDLFSSKIDIEHIIPKALLFDDSFSNKTLAFRETNLKKADRTAYGFIESDYNATLDDYIQRVETLYNNAKGTISKGKRNKLLMAQKNLPDGFIERDLRNSQYIAKKAKSMIEKVFNDVNVTSGSITDRLREDWDLINVMKELNFPKYKALGLTEIEERYDIGQEKTKKVEVITDWTKRNDHRHHAMDALTVAFTTKSHVQYLNNLNTIHSLKGDEVDLELSKLYGLKNTITEVVNKKRKFIPPMPNFREEAKKHIETILVSIKNKNKVYTKNINKTKKESGYHTKEQLTPRGQLHKETVYGKSKRPMNKPTKINKNFSLEQAQLIINVQEKELVLRHLAQFDNNPAVAFDTKTLKKMPLLKNGEPLKEVLCFEEIFTIRKDITPDLKIEKVVDEKIKAILEQRKKDFGGNAKEAFSDLDKNPIWLNKEKGICIKRVTITGVSNAEALHHQKDHLGREILDDNGNPIPADFVSTGNNHHVAIYEDEKGKLQEKVVSLYEAVARANQGLPVVDKGLNEDLGWKFLFTMKQNEMFVFPNDDFDVNDIDLLDENNAKIISQHLFRVQKLATKNYMFRHHLETNVQEVKELNDIAYKSIRSTEPLKNIKKVRINHIGKIVQVGEY

SEQ ID NO: 413 - protein, 1140 aa, Roseburia intestinalis
  Roseburia intestinalis L1-82
MRENGSDERRRNMDEKMDYRIGLDIGIASVGWAVLQNNSDDEPVRIVDLGVRIFDTAEIPKTGESLAGPRRAARTTRRRLRRRKHRLDRIKWLFENQGLINIDDFLKRYNMAGLPDVYQLRYEALDRKLTDEELAQVLLHIAKHRGFRSTRKAETAAKENGAVLKATDENQKRMQEKGYRTVGEMIYLDEAFRTGCSWSEKGYILTPRNKAENYQHTMLRAMLVEEVKEIFSSQRRLGNEKATEELEEKYLEIMTSQRSFDLGPGMQPDGKPSPYAMEGFSDRVGKCTFLGDQGELRGAKGTYTAEYFVALQKINHTKLVNQDGETRNFTEEERRALTLLLFTQKEVKYAAVRKKLGLPEDILFYNLNYKKAATKEEQQKENQNTEKAKFIGMPYYHDYKKCLEERVKYLTENEVRDLFDEIGMILTCYKNDDSRTERLAKLGLVPIEMEGLLAYTPTKFQHLSMKAMRNIIPFLEKGMTYDKACEEAGYDFKADSKGTKQKLLTGENVNQTINEITNPVVKRSVSQTVKVINAIIRTYGSPQAINIELAREMSKTFEERRKIKGDMEKRQKNNEDVKKQIQELGKLSPTGQDILKYRLWQEQQGICMYSGKTIPLEELFKPGYDIDHILPYSITFDDSFRNKVLVTSQENRQKGNRTPYEYMGNDEQRWNEFETRVKTTIRDYKKQQKLLKKHFSEEERSEFKERNLTDTKYITTVIYNMIRQNLEMAPLNRPEKKKQVRAVNGAITAYLRKRWGLPQKNRETDTHHAMDAVVIACCTDGMIQKISRYTKVRERCYSKGTEFVDAETGEIFRPEDYSRAEWDEIFGVHIPKPWETFRAELDVRMGDDPKGFLDTHSDVALELDYPEYIYENLRPIFVSRMPNHKVTGAAHADTIRSPRHFKDEGIVLTKTALTDLKLDKDGEIDGYYNPQSDLLLYEALKKQLLLYGNDAKKAFAQDFHKPKADGTEGPVVRKVKIQKKQTMGVFVDSGNGIAENGGMVRIDVFRVNGKYYFVPVYTADVVKKVLPNRASTAHKPYGEWKVMEDKDFLFSLYSRDLIHIKSKKDIPIKMVNGGMEGIKETYAYYIGADISAANIQGIAHDSRYKFRGLGIQSLDVLEKCQIDVLGHVSVVRSEKRMGFS

SEQ ID NO: 414 - protein, 1128 aa, Roseburia intestinalis
  Roseburia intestinalis M50/1
MDEKMDYRIGLDIGIASVGWAVLQNNSDDEPVRIVDLGVRIFDTAEIPKTGESLAGPRRAARTTRRRLRRRKHRLDRIKWLFENQGLINIDDFLKRYNMAGLPDVYQLRYEALDRKLTDEELAQVLLHIAKHRGFRSTRKAETAAKENGAVLKATDENQKRMQEKGYRTVGEMIYLDEAFRIGCSWSEKGYILTPRNKAENYQHTMLRAMLVEEVKEIFSSQRRLGNKKATEELEEKYLEIMTSQRSFDLGPGMQPDGKPSPYAMEGFSDRVGKCTFLGDQGELRGAKGTYTAEYFVALQKINHTKLVNQDGETRNFTEEERRALTLLLFTQKEVKYAAVRKKLGLPEDILFYNLNYKKAATKEEQQKENQNTEKAKFIGMPYYHDYKKCLEERVKYLTENEVRDLFDEIGMILTCYKNDDSRTERLAKLGLVPIEMEGLLAYTPTKFQHLSMKAMRNIIPFLEKGMTYDKACEEAGYDFKADSKGTKQKLLTGENVNQTINEITNPVVKRSVSQTVKVINAIIRTYGSPQAINIELAREMSKTFEERRKIKGDMEKRQKNNEDVKKQIQELGKLSPTGQDILKYRLWQEQQGICMYSGKTIPLEELFKPGYDIDHILPYSITFDDSFRNKVLVTSQENRQKGNRTPYEYMGNDEQRWNEFETRVKTTIRDYKKQQKLLKKHFSEEERSEFKERNLTDTKYITTVIYNMIRQNLEMAPLNRPEKKKQVRAVNGAITAYLRKRWGLPQKNRETDTHHAMDAVVIACCTDGMIQKISRYTKVRERCYSKGTEFVDAETGEIFRPEDYSRAEWDEIFGVHIPKPWETFRAELDVRMGDDPKGFLDTHSDVALELDYPEYIYENLRPIFVSRMPNHKVTGAAHADTIRSPRHFKDEGIVLTKTALTDLKLDKDGEIDGYYNPQSDLLLYEALKKQLLLYGNDAKKAFAQDFHKPKADGTEGPVVRKVKIQKKQTMGVFVDSGNGIAENGGMVRIDVFRVNGKYYFVPVYTADVVKKVLPNRASTANKPYSEWRTMEDKDFLFSLYSRDLVHIKSKKGIPIKNVDGSLGESKEVYAYYIGADISGAKIEGKAHDSRYTFRGIGVQKLELIEKCQVDILGHISTVKNEKRMGFS

SEQ ID NO: 415 - protein, 1152 aa, Roseburia inulinivorans
  Roseburia inulinivorans DSM 16841
MNAEHGKEGLLIMEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKEKEGGAVLKATTENQKIMQEKGYRTVGEMLYLDEAFHTECLWNEKGYVLTPRNRPDDYKHTILRSMLVEEVHAIFAAQRAHGNQKATEGLEEAYVEIMTSQRSFDMGPGLQPDGKPSPYAMEGFGDRVGKCTFEKDEYRAPKATYTAELFVALQKINHTKLIDEFGTGRFFSEEERKTIIGLLLSSKELKYGTIRKKLNIDPSLKFNSLNYSAKKEGETEEERVLDTEKAKFASMFWTYEYSKCLKDRTEEMPVGEKADLFDRIGEILTAYKNDDSRSSRLKELGLSGEEIDGLLDLSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFDGGYDIDHILPYSITFDDSYRNKVLVTAQENRQKGNRTPYEYFGADEKRWEDYEASVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAATHTKPYSEWRVMDDANFVFSLYSRDLIHVKSKKDIKTNLVNGGLLLQKEIFAYYTGADIATASIAGFANDSNFKFRGLGIQSLEIFEKCQVDILGNISVVRHENRQEFH

SEQ ID NO: 416 - protein, 1156 aa, Ruminococcus albus
  Ruminococcus albus 8
MGNYYLGLDVGIGSIGWAVINIEKKRIEDFNVRIFKSGEIQEKNRNSRASQQCRRSRGLRRLYRRKSHRKLRLKNYLSIIGLTTSEKIDYYYETADNNVIQLRNKGLSEKLTPEEIAACLIHICNNRGYKDFYEVNVEDIEDPDERNEYKEEHDSIVLISNLMNEGGYCTPAEMICNCREFDEPNSVYRKFHNSAASKNHYLITRHMLVKEVDLILENQSKYYGILDDKTIAKIKDIIFAQRDFEIGPGKNERFRRFTGYLDSIGKCQFFKDQERGSRFTVIADIYAFVNVLSQYTYTNNRGESVFDTSFANDLINSALKNGSMDKRELKAIAKSYHIDISDKNSDTSLTKCFKYIKVVKPLFEKYGYDWDKLIENYTDTDNNVLNRIGIVLSQAQTPKRRREKLKALNIGLDDGLINELTKLKLSGTANVSYKYMQGSIEAFCEGDLYGKYQAKFNKEIPDIDENAKPQKLPPFKNEDDCEFFKNPVVFRSINETRKLINAIIDKYGYPAAVNIETADELNKTFEDRAIDTKRNNDNQKENDRIVKEIIECIKCDEVHARHLIEKYKLWEAQEGKCLYSGETITKEDMLRDKDKLFEVDHIVPYSLILDNTINNKALVYAEENQKKGQRTPLMYMNEAQAADYRVRVNTMFKSKKCSKKKYQYLMLPDLNDQELLGGWRSRNLNDTRYICKYLVNYLRKNLRFDRSYESSDEDDLKIRDHYRVFPVKSRFTSMFRRWWLNEKTWGRYDKAELKKLTYLDHAADAIIIANCRPEYVVLAGEKLKLNKMYHQAGKRITPEYEQSKKACIDNLYKLFRMDRRTAEKLLSGHGRLTPIIPNLSEEVDKRLWDKNIYEQFWKDDKDKKSCEELYRENVASLYKGDPKFASSLSMPVISLKPDHKYRGTITGEEAIRVKEIDGKLIKLKRKSISEITAESINSIYTDDKILIDSLKTIFEQADYKDVGDYLKKTNQHFFTTSSGKRVNKVTVIEKVPSRWLRKEIDDNNFSLLNDSSYYCIELYKDSKGDNNLQGIAMSDIVHDRKTKKLYLKPDFNYPDDYYTHVMYIFPGDYLRIKSTSKKSGEQLKFEGYFISVKNVNENSFRFISDNKPCAKDKRVSITKKDIVIKLAVDLMGKVQGENNGKGISCGEPLSLLKEKN

SEQ ID NO: 417 - protein, 1341 aa, Ruminococcus lactaris
  Ruminococcus lactaris ATCC 29176
MGKGYYVGLDMGTGSVGWAVTDESYQILRRHGKAMWGVRLFESAKTAEERRMFRTGRRRLDRRGWRIEILQEIFAEEISRVDPGFFLRMKESKYYPEDKRDIQGNCPELPYTLFVDKTFTDKDFHKKYPTIYHLRKMLMETEDTPDMRLVYLALHHMMKHRGHFLLSGDISQVTEFKNTFNQFIENIRNEEMDFEIELDESAVQMIEETLKDKNLTRSAKKSKLVKGLNAKNVRDKAFLTLLSGGTVKLSDLFGMEELNEGERPKISFADNGYEEYAAVVEMELGELYYIVESAKAVYDWAILSDILGGSTSVSDAKVRAYEKHKADLKYLKAVVKEYFPKEVYNAVFVESSDKLNNYPAYIGMTKKNGKKVSLEGKRCSREEFMDFLKKNIVVKLPDEEAKMYLQSELEKDSFLPKQVNKDNGVIPYQVHKYELKKILDNLGDKIPFLKENAEKIEKLFSFRIPYYVGPLRTGNGENSKFAWAERKSTEKIYPWNFENVIDVEQSAENFIRRMTNKCTYLIGEDVLPKDSLLYSKFMVLNELNNLRLDGQKISVELKQKIYRDVFCRSRKVTQKKLKSYLIREGIAGKNVELTGIDGDFKGSLTAYHDFKEKLIDVELTQKEKEEIILNIVLFGDDKKLLKQRLKKKFPQLTEKQINTVTALSYKGWGRLSKKLLEEVTVPAPETGEVWNIITALWETNDNFMQLLSKEYQFSDRIEEFNEEKADPEVSYQTIEDLYVSPAVKRQIWQTLQIIQEIEKVMGEKPKRVFVEMAREKQENKRTESRKKTLSDLYTKCKKEEPEWIEALCTSLEKHEEHQLRSDKLYLYYTQKGRCMYSGEPIDLEDLWDNTKYDIDHIYPQSKTMDDSLKNRVLVKKEYNAKKSDTYPIAADIQKKMMPFWKSLLTGGFIPKEKYDRLVRNNPLDANELAGFIERQIVETRQSTKAVAEILKKILPDTEIVYVKAKTVSKFRQDFDFIKVRDMNDLHHAKDAYLNIVVGNVYFVKFTKNAAWFVKENPGRTYNLEKMFIWDVARDGEIAWKAGKSGSIVQVRAMMEKNHILVTRRSYEVKGGLFDQQILKKGKGQVPVKESDERLRDIGKYGGYNKAAGVYFMLVSSKDKKGKEQRTIEFVPIYLKDRVEKDMESARNYLMEERGLREPKILIKKIKIDTLFKVDGFYMWLSGRTSNQLIFKGANQLILSKEDMKTLKKVVKYIQRQKEDKNVKISMRDGITEEELLKLYETFLDKIRHSIYGARLSSQEKTLVNGKEKFIDLSVEAKCQVLYEILHLFQCQSGAANLKMIGGPASAGILVMNNNISKCKNISIVNQSPTGIYEKEIDLLRV

SEQ ID NO: 418 - protein, 1471 aa, Scardovia wiggsiae
  Scardovia wiggsiae F0424
MGYKAPRNDKGEIDYGVGLDLGNGSVGWVAMDKDYHLIRARGHELIGARLFDPANSAENRRESRTTRRRLSRRRWRLRMLDSLFASELAKIDPNFLARRKYSWVHPKDEQNHENWYGSIIFGSKEQDKQFYKDYPTIYHLRKKLTEDTERHDIREIYVAIHHIVKYRGHFLREGEINSENLFDPEGFVELIKDVIKLNNSYDESTPIFEASPADVSEALLNEHTSRSGRIEDTLDKLDFSVSRVDKHELKGMRDAAKAVIGAIVGNTADFSKIFNLDNLDKDSKDNLKLKFADSNFDEKYGGVVGSGLLDETQIELVDRIHAVYDAVALKGILGDAHTISEAKVESYEKHRKNWKLIKEELRTKENKDEVDLWYGDLSGRQYKNPPDPEKGPDEGSKKDSPIRDSDQKQNLIKKANDYFTELIDDSQLSEEQKNCLKNDINNGQLFPVQRSSDNGVIPYQIHLNELRRIIENQKQYYPFLAETFIRKTAEGKSYEENKIVALLKFRVPYYVGPLVSKEDMEEHSSGNSAYHWMARNPGRGEAITPWNFDEVVDKDESGARFISRLTGTDTYLLGEPTLPQHSLLYEEYMVLSELNNVRLNVRQGNHWSDKNRQRLSYKQKEFLIENLFKEHKTVTRKRAEDCLSSMGCGEVQLFGLSDEKKFASSLSSYITLKKILGKAFVDDSGNSAILERIIEVQTVFEDREPLTHQLSLIDSLTVEQRKQLAKIHYTGWGKLSRKLLTSKKGSYKIHSQNEIMRTQHSIIDIMRGDSLNLIEIIRDKKIGIGEWIDNENLDRETGESDVSRLESVFEGIVMSPRVKRGVVQAVRVIDDLAKAIGNPPQRIFIEMADEVQASQRTVSRLSRLKALYGSPSLQKEFNDLKDLRKSLNETKDADLQEDRLYLYYIQLGKDLYTGKEISIDSLSSAYDIDHIVPQALTQDDSIDNRVLVSRKENARKTDSYLYTPDLIKNMRPLWGKLLAAGLMSQKKYDALTRVDDFKDREKQRFVQRSLVETRQIMKNVSTILRTYYGEDTNVVTLKSSITHDMRKYLGFPYKNRDINDYHHAQDALCISAAGQFMLNRHFVSGGEVTDGASNAYNMYLAEYLQEFRDAKARGERKRSTAFGFVVGSMSSKDDEKRTDHRTGEIVWSETNAEYLRKVMNYKKMLITQKVGDVKTRALYDETRYGHKESSAKSIKFDNLRRDTSLYGGFSGASTAYMMLVEYKKKNKLVSITAQEASLLAVADQKNDTVSVMDGILASHGLSGAKILLPKIVTGQLLDYSDALVTLQSASELNTARQMWLPRNDYNDIDIILKSKDIEDAAHKLGYDSDTVHVLRRIQKLFEAVFRVAESQFPLHQLSKDQQEEILRDPQNYGFGSAVKLLGGLLKALHANAENTNLAGLVKVLHGDKEYSDDGKAKEFKKFGFSPRWRRISNPTGFTLSDSDTFIYQSPSGIFEQRVTVKELKEKADKQK

SEQ ID NO: 419 - protein, 1178 aa, Scardovia inopinata
  Scardovia inopinata F0304
MGKRHNSNMAKKKISYRIGIDVGLNSTGLAAIEVDDDGAPIRILNTMSVIHDGGVDPDAAKVRGTRLAISGIARRTRRMRRRRAKRLDRLEQILEKYGYTDTEPVLEEPYGPWICRAELADGFINDDEQRRMMIGIAIRHIARHRGWRNPYQNVRALLNIDDSDLSEEYKNLKEKVQDQINDGKDLPNFTPSQLVRDYLDNFSGQPAARIRTGKAGPRGNRRDAVGILPQRMRQSDYAYELQRIFDMQKIGRDEAQELLMAVFEAKSPKGSAEKRIGKDPLTGKKRALKASLAFQKYRIVATITNLRIKTGTGSERMLSPTELNDIYTYLLRVQDDNHLPTWEDICEEVLHIGRYQLAGIGKTFEGGERISNMPPVIQTSLAIHGLSEGTLAEKLTKWWDKADDDSRESMIKLLSNTVDIDRVNEVDENFASALDFIDSLDDEELTKLDKIALPRGRAAYSEEALNKLTADMLNTGDDLFSARQRIYHVNNSWRPPQPPIGEPLGNPAVDRVLKITNRYLMNCLNRWGQPRRVTIEHTRSGFTSVKQATEHQKISDKRAEYRRDIVKQLEEAGVESVHEYDIRRWEAVQRQNGQCLYCGRDITFKTCEMDHIVPRKGPGSTNTRTNFAAVCPECNRMKSNIPFASWAETKEAKDRGVSLDKAIKQVRFFNFTKNEYSPQAQRNFKKSMIERLKQKTSDEPLDNRSIESVSWMADELYKRIDWYFNHEQYETSKKAINDDKDNLSGTQVVVYPGSITAEARNAAGLGGNIHFIGGRYKTRLDRRHHAVDACVIAMMEPGIARILTERNQLRQAQRLTARIEDDEVNWKDYPTENTAGYNKYQAWSDRMHALLEYMNNALDYDKIPVVRWERLQLGNRSAHEDTIHPLKKLPLSHEISAIDINHASTPALYEALVSLPDFSEQDGLPADPSRQINVNGERYSGDDLVSFFNSNAAQIAIQGGSAELGTAFHHARIYRCWTVGKNGKKKIFFGMIRVYQHDLLHAKNEDLFTYPLKRSSVSMRYAKKEVVHAILSGNAEYVGYLCVGDELVLDLKGDKSNDEGGSRLSGQVGEFVQKFEEDSKVNSQIVNRWTVDGFPDEAKLRLRPSMFAGEGLKNMKSELVENAAIKNILSKTGWRVSVDVISKKSPVVLRRNAFGEPRWKTNAGLPVSYRWQDTETKE

SEQ ID NO: 420 - protein, 1063 aa, Simonsiella muelleri
  Simonsiella muelleri ATCC 29453
MEKFHYVLGLDLGIASVGWAAIEIDKETETSIGLLDCGVRTFERAEVPKTGDSLAKARREARSTRRLIRRRSHRLLRLKRLLKREIFRQPETFKDLPINAWQLRVKGLDSRLNEYEWAAVLLHLVKHRGYLSQRKSEMSETDSKSEMGRLLAGVAENHQLLQQEQYRTPAELALKKFVKHFRNKGGDYAHTFNRLDLQAELHLLFQKQRELGNPFTSPELERQVDDLLMTQRSALQGDAILKMLGHCGFEPEQFKAAKNTFSAERFIWLTKLNNLRIQDQGKERALTADERTKLLDEPYKKSKLTYAQVRKLLSLPQTAIFKGLRYDLEHDKKAENSTLMEMKSYHNIRQTLEKSGLKTEWQSIATQPEILDAIGTAFSIYKTDEDISHELKTCRLPENVLNELLKNINFDGFIQLSLTALRKILPLMEQGYRYDEACTQIYGNHHSGSLQQESKQFLPHIPIDDVRNPVVFRTLTQARKVVNAIIRRYGSPARVHIEMARELGKSKSDRDRIEKQQQKNKKERENAVAKFKEDFPDFVGEPRGKDILKMRLYEQQHGKCLYSGHDIDINRLNEKGYVEIDHALPFSRTWDDSQNNKVLVLGSENQNKRNQTPDEYLDGANNSQRWLEFQARVQTCHFSYGKKQRIQLAKLDDETEKGFLERNLNDTRYIARFMCQFVQENLYLTGKGKRLVFASNGGMTATLRNLWGLRKVREDNDRHHALDAIVVACSTASMQQKITKAFQRHESIEYVDTETGEVKFRIPQPWDFFRQEVMIRVFSDQPCEDLVEKLSARPEALHDNVTPLFVSRAPNRKMSGQGHLETIKSAKRLSEENSMVKKPLTTLKLKDIPEIVGYPSREPQLYAALKTRLETHDDDPIKAFAKPFYKPNKNGELGALVRSVRVKGVQNTGVMVHDGKGIADNATMVRVDVYTKAGKNYLVPVYVWQVAQGILPNRAVTSGKSEADWDLIDESFEFKFSLSRGDLVEMISNKGRIFGYYNGLDRANGSIGIREHDLEKSKGKDGVHRVGVKTATAFNKYHVDPLGKEIHRCSSEPRPTLKIKSKK

SEQ ID NO: 421 - protein, 1327 aa, Solobacterium moorei
  Solobacterium moorei F0204
MEGQMKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 422 - protein, 1179 aa, Sphaerochaeta globosa
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 423 - protein, 1426 aa, Sphingobacterium spiritivorum
  Sphingobacterium spiritivorum ATCC 33861
MKHILGLDLGTNSIGWALIKQDFENKQGEILGMGSRIIPMSQDILGDFGKGNSVSQTAERTKYRSVRRLRERFLLRRERLHRILNVLGFLPEHYASQIDFTKRFGKFKEETEPKLVYSNEGFIFKKSFEEMLSDFKTHQPQLLEDNKKIPYDWTIYYLRKKALSRKIEKEELAWILLNFNQKRGYYQLRGEEEEENPNKLIEFYSLKIVDVLADEPQKGKSDIWYSLILENGWIYRRSSKTPLFDWKEKTRDFIVTIDLNDDGSVKTDKEGNEKRSFRAPGENDWTLVKKKTEQEIDSSRKTVGTYIYETLLKNPKQKIKGKLVRTIERKFYKTELKQILEKQKEFHPELRQDDLYSDCVRELYKNNEAHQLTLSKKDFVHLFMEDIIFYQRPLGSQKSSISNCTLEFRKYKDENGTEHTQYLKAIPKSNPYYQEFRIWQWMYNLNIYKKEDDTNVTKDFLNTKADFESLFEFLNNRKEVDQKALLKHFKLNDKTHRWNYVEDKKYPCNETKTMILSRLDKVENISDDFLTREMEQKIWHIIYSVNDKVEYEKALKSFAGKNNLEDNSFFEAFKKFPPFKSEYGAFSEKAIKKLLPLMRMGKFWNYNNISEQSKSRIQKIITGEYDENIKDKVREKAIHLTTETDFQGLQLWLVQYIVYGRHSEAAMLGKWNSADDLEEFLKEFKQHSLRNPIVEQVITETLRVVKDIWQKYGNGAKDFFREIHIELGREMKLPAEERERLTRQISENENTNFRIKALLAEMMDDNSVENVRPFSPMQQEILKIYEEGVLNSDIEIEDDILKISKTAQPSSSDLKRYKLWLEQKYKSPYTGQIIPLNKLFTPEYEIEHIIPQSRYFDDSFTNKIICESAVNKLKDNYIGLEFIKKLGGSIVECGNGKSVAILKHDAYEDFIKKHYANNRSKRNKLLLEDIPEKMIERQMNDTRYISKYISGVLSNIVRVEDGTDEGVNSKNIVPGNGKITTQLKQDWGLNDVWNDLILPRFERMNHLTNSTDFTAWNENHQKFLPTVPVEFSKGFSKKRIDHRHHALDALVIACATKDHVNLLNNQSAKSDTKRYDLKKKLMKFEKVAYNHPQTGERIEREAPKQFLKPWETFTIDAKNHLETIIVSFKQNLRVINKATNYYEKYVEKEGTKVKERVEQKGTNWAIRKPMHKETVSGKIDLPRIKVPKGKILTATRKSLDTSFNLKTIGSITDTGIQKILKNYLQYKDNNPELAFSPEGIEDMNKNIEKFNNGKAHQSISKVRVFELGSKFPLGQSGNKKEKYVEAAKGTNLFFAIYQDKNGKRSYETIPLNEVIERQKQGLSVVDLKGVDDFYLSPNDLVYVPSEDELENISMIDFNKMSSERIYKVVSFTGNQIFFVRQDIATSVVNKAEFSTLNKMERAIDGTMIKETCVKLQIDRLGNISKI

SEQ ID NO: 424 - protein, 1110 aa, Sphingobium sp.
  Sphingobium sp. AP49
MAEGKKRIWRLGADLGANSLGWAAIELSAPVNGKPIAILAAGSRIFSDGRDPKSGASLAVDRRDARAMRRRRDRFKQRQKALIKYLIADGLFPADEAARNAMAAIDPYAVRARALDEALSLPELGRALFHLNQRRGFKSNRKADRKADDDAGKIAIGIDRTRDAIAEDEADAGAEPGSWTFGKWLHERRLKGQSVRTRLRPESGEDAKGDGYDFYPDRALMEEEFDAIWAAQAPHHPDVLTNDVHDRLHEIIFYQRPLKAPQVGMCSLIPGDRRLPKAHPLFQRRRLLEELNALMIVRPGEVAQRLTREERDILLLKLKDKNKVSFATLRKALKLDPDARFNKESEDRTDLKGDEVAAVMGSKTRFGNLWVHLSIEAQWDVLARLDAVESDAEDAAFCAWLVETYALTPEQARAVANAPLPPGYGRFGETATRKLIEALRDGKKDDRVLVYSEAVTEAGLGHHSDRRTGEVFEDAKGRPQLPYYGVALERHIMPGTGDPSDPEEMRVGRLTNPTVHIGLNQLRRILNVLIRAYGPPAEIAIELARELKLTDEDKKRINRENNDNRIAAERRSEKLLAIGQADSGANRALLKLWEELNPANVLDRRCIYSGRQISIDMLFSAAVEVDHILPFAATLDDSNGNKIVCLREANREKRKRSPHDAWGHSARWDEIAARAAQLPRNKRWRFEPDAMDKFRDEGGFQARHLVDTQYLARLSREYLATLYPEKGEGSGHIWVSPGRLTEMVRRKLGLNDLLPDHNFGGGADQAKNRLDHRHHAIDAVVVAIVDRGMLNAIARASGQEGAEGRERIIIPEPWDGFRDALRETVNRITVSHRTDHGTASKAGLPKGKDATAGRLHNDTAYGFTGDTDAKGNSIVVRRVPLSSFKKLADLDRIRDADLKAALYQHLNGLEGKAFEKALAEFHKLEWHNFGGVRRVRVTEPLTVIPIKDRNGRIYKGYKGDSNYRYDVWELPDGKWVTNWKNEAGEAMSSVISMFDAHQSSEPPRPHPAARKILSLHQNDLLAIEREGEDRKLMRVVKFGQSGQITLAEHQQAGDLKKRDAVSNDDDPFKYFAPTSGGLKKVKARQVRIDEIGRVLDPGFPARTARRKTRG

SEQ ID NO: 425 - protein, 1090 aa, Sphingomonas sp.
  Sphingomonas sp. S17
MDWRLGLDLGANSLGWAALRLDRAGDPIGILAMGSRIFSDGRDPKSGASLAVDRRAARAMRRRRDRFKQRQAALLKYLIRDGLFPADQADRQRLADEDPYALRARALDEELSLFEIGRALFHLNQRRGFQSNRKADRGQDDEAGKIAVGVDRLNQQMEEQGARTLGEFLHQRRRAATDANHIPSVRTRLRPETGEGAKGDGYDFYPSRALIAEEFEEIWAAQAPHYPDTLTQQVHDRLYEIIFHQRPLRAPQVGQCTLVAGETRLPKAHPLFQKRRLLEEINALMIVRPGEIAQRLTPEERDTLYLKLKDKRTVSFATLRKTLKLDSAARFNKESENRTELKGDEVAAELGAKTRLGTRWQHLSGDQQWEVVHRLMALESQADEAAFRDWISQTYDLLPEQAAAVLGARLPQGHGRFGPTATTTLIDSLLHDRTEDGRVVVYSEAVQRSGLGHHSDLRHDRDDEDVTELPYYGVALERHIMPGTAEPTDPEEMRIGRLTNPTVHIGLNQLRHVVNRLIRAYGPPKEIAIELARELKLSEDEKKKRNSENRDNRLAAEGRSKKLEEIRQRDTGANRALLKLWEELNPGNVLDRRCIYTGEQISIDMLFSDRVEVDHILPFAQTLDDSNGNKLLCLREANREKRRRSPYEAWGHTDRWPDIAERASRLPKPKRWRFEPDAMQRFATEDGFLARHLVDTQYLGRLAREYLSWLYPGRGEGSGHVWVSPGRLTEMVRRKLGLNDLLPDHNFGGGADQPKNRLDHRHHAIDALVVAIVDRGMLQAIARASGQDGSEGRERIHIPAPWDGFRDDLRVAVNGIIVSHRPDHGTVAKAGLARGRDQTAGRLHNDTAYGLTGETDAKGNSIVVRRIPLSAIKKPADIARVRDPLLRNALAEFTKGLDGKAFEARIGRFHELGPLLYRGIRRVRVVETLTVIPIRDAEGRAYKGYKGDSNYRYDVWEMPDGKWRCQVVSMFDAHQSTEQARPHPAARKILSLQRNDILAIERTEGDRELVRVVKFSEKQFAVAPPHEGGSLKTRDGNADDPFRYLYPSPNTLKGWRARQVRIDELGRVLDPGFPARKSVRRTRPRAAPVD

SEQ ID NO: 426 - protein, 1084 aa, Sporolactobacillus vineae
  Sporolactobacillus vineae DSM 21990 = SL153
MKYSIGLDIGISSVGWSVINLDRERIELMGARLFDAAENPKNGSSLAAPRRDARSARRRLRRRRYRVGRVRHFIIDRGLVTRGQADQLFDWKDGDLDIWLVRVNALERLLTDREFARVLIHIAKNRGYRSNRKSEAKSGENGQVLSAIKANKELMEEKGYQTVAEMLVNEPETFAGRKRNRGGEYTHVIARSELEHEIRLIFTKQRAFGNRFATEENENTYVKIWAAQRPVATKDDILKKIGDCTFEKGEKRAPKASYAFQYFRALDKLNRLRILSVREPSRNLTDDERNLIVPALFNHDKQKYSDLRKILQLRDDQKFNELFYDPGKSLKENENKTFLSLAEQYKIRKVIRDVQGKDGLLQYRPLDIDTIAYALTVFKDDQDTRDYLSNTFVNGNGKQVLNLANRAFDAELIDGLLSLSFAKFGHLSLKALHKLIPHMEQGLSYYDACKKVGYHDNEQVGKSKQHLLPVIPADEIRNPVVVRSLSQTRKVINAIIKRYGSPTFMYIELAREMGRPYNERRDLEKQYNKNRTVNDSAIEQIHELYPEIGAPRGHDILKYKLWQQQDCKCAYSLEKIPAEKIFEPGYAEVDHIIPYSRSFDDSNSNKVLVLSRMNQEKKNRTPYEWFGGDEHRWNKFESYVNALKVNRKKKSLLTKKNMDTEEEDTFKSRHLNDTRYITRFIKSFVEDNLLFREIEGAKQHVFTVNGAYTSLMRKRWGFNKNREESDLHHSVDAVIIAVSQPFRNEVSRYFKHREISLPQLLKRTWDYFPEPWEGFVKELRARTLQDPEKLKLALESLDLDSYDPEFIDEVKPIFISRMPKRSIKGQIHDETLRRNRGKTKDGFVKIVTRTRLENIKFDKNGDFPMYGRESDPKTYQAIKQRYLENNKDKKKAFIEPLYKPAKNPNNASLIRSVKIEDKANQIVPLRDEAVAYNASIVRTEVYRNKETGKFYLAPVYVSDVFAGREPRRFIRANVPYEQWVNITDKFTFLFNLYPNDVIYIKMKKVKTTKSNINKTISWQESYFYFKGTDIHTGAITIIDHMNSFTDRVGTQGLQLFEKYQVDPLGNLSRVHGETQYGVPALSHS

SEQ ID NO: 427 - protein, 1053 aa, Staphylococcus aureus; identical to SEQ ID NO: 28
  Staphylococcus aureus subsp. aureus

SEQ ID NO: 428 - protein, 1054 aa, Staphylococcus lugdunensis
  Staphylococcus lugdunensis M23590
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 429 - protein, 1334 aa, Staphylococcus pseudintermedius
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 430 - protein, 1334 aa, Staphylococcus pseudintermedius; identical to SEQ ID NO: 429
  Staphylococcus pseudintermedius ED99

SEQ ID NO: 431 - protein, 1112 aa, Staphylococcus simulans
  Staphylococcus simulans ACS-120-V-Sch1
MLVGLKFKQSILFENMENAEDIKESATGSDAISLSDDYYENLSEFLTDEQLNFIESANTFFMGIMLDRILKGATSISAAKVRDYKIFKSQLKLIKDIVYQNKYDKYHEFFVTSKEDMRAYQENPDAKNFGKLSKFDQYLIHSKDQYAKLMKDLKGLVPKEYTEVLNLIDEQKFLVVQNTTDNASIPYQNNVFEAENILRNQQKYYPEITEEMIGKVINLISFRIPYYVGPLTNKNGQSDFAWMIRKSDEQTLPWNFDKVIDKSKSAEKFIRRMTSKCTYLLEEDVLPKHSLLYQEMEVLNELNNVQLRGENEPKHRIHRLDPKVKQFIYHNLFQKKKNVTHKDLITLLQNSEHRNTLNKTSGQKLKVFGTQNDSKFASKLSTYNDMKAILGSVENKRQMIEELVLWITIFEDKAILKQKIGEKYPNITEKQLNQIVKLNYSGWGRLSEKLLTKEVNGRSLIDLMYSTENNFMEIITDKTLGFDCFIKNSNKVKNAKISYKDVAELRTSPALKKGIWNAIKMVREISNLFGAPEKIIIEFATEDQAKGKRQKSRSELWDDLVKKNNLKRNKEFEGLFEELKAYPDLDFSNPKLWLYIHQNGKCMYTKKPIDLERLMSDTNNQLYEIDHILPRTFVKDDSINNKVLVIQSANQKKSGDKMPLEIFDNHVLVPFWKMLYENDLISSSKLSKLMKKEFNDLDKEGFIQRQLVETRQIISHVSDFLTEEYPSTTVVPMKANVVSELRRKFDIPKIRQLNDWHHAVDAYLNGFVYQAARVFYPKVNLFEFNFKWEKVREKWRQLGEFTENNKKREFFLFKRMENYVNEYGEGMISKLIFDLDNFKFNYSRKVESTESAFYKQSAFSPKNTTAQYDSDKNKTAIYKEMKNKRGIVVSYTYVKKDQELIGYGVFNETVFEYVNNADVDMNTRALKIVRKAFPKLDIKKAQYLFSINKGDALLVNGHPFLFVSAYERINGKQLEFDIAMQRKIKQALSPYNNMTEQEKVEFYNQFAEKVIEEFRNSIGLQSRDRKVNLIKNLFNNTEKSNDSMTQSILEVLKMTKVSAERSKELKIRWNGQTPNTFIDTKNNAEIQYKSITGLKTTKPKSIFKLAESKNEL

SEQ ID NO: 432 - protein, 1370 aa, Streptococcus agalactiae
  Streptococcus agalactiae 2603V/R
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 433 - protein, 1377 aa, Streptococcus agalactiae
  Streptococcus agalactiae 515
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHHEDLKHLKQFVKASLPENYREVFADSSKDGYAGYIEGKTNQEAFYKYLLKLLTKQEGSEYFLEKIKNEDFLRKQRTFDNGSIPHQVHLTELRAIIRRQSEYYPFLKENQDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKCLDIYKDFFTESQLKKLYRRHYTGWGRLSAKLINGIRNKENQKTILDYLIDDGSANRNFMQLINDDDLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGRDMYTKKALDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNEVDNGKKICKVKIVTLKSNLVSNFRKEFGFYKIREVNDYHHAHDAYLNAVVAKAILTKYPQLEPEFVYGMYRQKKLSKIVHEDKEEKYSEATRKMFFYSNLMNMFKRVVRLADGSIVVRPVIETGRYMGKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 434 - protein, 1370 aa, Streptococcus agalactiae; identical to SEQ ID NO: 432

SEQ ID NO: 435 - protein, 1378 aa, Streptococcus agalactiae
  Streptococcus agalactiae ATCC 13813
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVIDLSTKAPLSASMIQRYDEHHEDLKHLKQFVKASLPENYREVFADSSKDGYAGYIEGKTSQEAFYKYLLKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIIQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLGNLKSNILEEKKPKYVKDQVENHHLSDDRLFLYYLQNGKDMYTDDELDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGLYRRKKLSKIVREDKEEKYSEATRKMFFYSNLMNMFKRVVRLADGSIVVRPVIETGRYMGKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNTSAFLESKGYLNIRDDKLMILPKYSLFELENGRRRLLASAGELQKGNELALPTQFMKFLYLASRYNESKGKPEEIEKKQEFVNQHVSYFDDILQLINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 436 - protein, 1370 aa, Streptococcus agalactiae
  Streptococcus agalactiae CJB111
  MOD_RES (117)..(117): Any amino acid
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYXIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 437 - protein, 1370 aa, Streptococcus agalactiae
  Streptococcus agalactiae COH1
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 438 - protein, 1370 aa, Streptococcus agalactiae
  Streptococcus agalactiae FSL S3-026
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 439 - protein, 1370 aa, Streptococcus agalactiae
  Streptococcus agalactiae GB00112
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 440 - protein, 1370 aa, Streptococcus agalactiae
  Streptococcus agalactiae H36B
  MOD_RES (9)..(9): Any amino acid
MNKPYSIGXDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 441 - protein, 1377 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHHEDLKHLKQFVKASLPENYREVFADSSKDGYAGYIEGKTNQEAFYKYLLKLLTKQEGSEYFLEKIKNEDFLRKQRTFDNGSIPHQVHLTELRAIIRRQSEYYPFLKENQDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKCLDIYKDFFTESQLKKLYRRHYTGWGRLSAKLINGIRNKENQKTILDYLIDDGSANRNFMQLINDDDLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGRDMYTKKALDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNEVDNGKKICKVKIVTLKSNLVSNFRKEFGFYKIREVNDYHHAHDAYLNAVVAKAILTKYPQLEPEFVYGMYRQKKLSKIVHEDKEEKYSEATRKMFFYSNLMNMFKRVVRLADGSIVVRPVIETGRYMRKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 442 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 443 - protein, 1370 aa, Streptococcus agalactiae
  Streptococcus agalactiae STIR-CD-17
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSAYMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHISYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 444 - protein, 1125 aa, Streptococcus anginosus
  Streptococcus anginosus 1_2_62CV
MNGLVLGLDIGIASVGVGILNKETGEIIHANSRIFPAATADSNVERRGFRQGRRLGRRKKHRSARLNNLFEEFGFITDFSAIPLNLNPYALRVKGLSEELTNEELFIALKNIIKRRGISYLDDASEDGETASNEYGKAVEENRKLLADKTPGQIQLERFEKYGQVRGDFTVVENGENHRLINVFSTSAYKKEAERILRRQQEFNVRISDEFIEAYLTILTGKRKYYHGPGNEKSRTDYGRFRTDGTTLDNIFGILIGKCTFYPDEYRAAKASYTAQEFNLLNDLNNLTVPTETKKLSPEQKRQIVEYARTAKTLGTPTLLKYIAKLVDGSIDDIKGYRIDKSDKPEMHTFDAYRKMRTLDLVNIDALSRETLDDLAHILTLNTESEGILEALNSKMPSTFTKEQIDELIQFRKKNSAVFGKGWHNFSLKLMNELISELYETSEEQMTILTRLGKQRSREISKRTKYIDEKELTEEIYNPVVAKSVRQAIKIINEATKRYGIFDNIVIEMARENNEEDAKKDYIKRQKANQDEKNASMEKAAFQYNGKKELPDSIFHGHKELATKIRLWHQQGERCLYTGKNISIRDLIHNPHQYEIDHILPLSLSFDDGLANKVLVLATANQEKGQRTPFQAIDSMDDAWSYREFKQYVRNSKSLSNKKKDYLLTEEDISKIEVKQKFIERNLVDTRYSSRVVLNTLQEFYKTNDFDTKISVVRGQFTSQLRRKWKIEKSRDTYHHHAVDALIIAASSQLRLWKKQNNPLISYKEGQFVDPETGEILSLTDDEYKELVFRPPYDYFVDTLKSKSFEDSILFSYQVDSKYNRKISDATIYGTRKAQLGKDKQEETYVLGKIKDIYSQKGYEDFIKRYNKDETQFLIYHKDPQTFEKVIEEILKTYPDKELNEKGKEIPCNPFEKYRQENGPIRKYSKKGKGPEIKSLKYYDNKLGNHIDITPVNSQNQVVLQSLKPWRTDVYFNPRTSKYELMGLKYSDLRFEKGSGSYGISPEKYNKVKAKEGVNEDSEFKFTLYKNDLILIKDTETGEQQLFRYGSRNDTSKHYVELKPYEKAKFEGNQQLMNLLGTVAKGGQCLKGINKPNLSIYKVKTDVLGNKYFIKKEGDQPQLNFKKKF

SEQ ID NO: 445 - protein, 1345 aa, Streptococcus anginosus
  Streptococcus anginosus F0211
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQMTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 446 - protein, 1386 aa, Streptococcus anginosus
  Streptococcus anginosus SK1138
MNQKYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVDEDKRGERHPIFGNIAAEVKYHDEFPTIYHLRKHLADISQKADLRLVYLALAHMIKFRGHFLIEGQLKAENTNVQALFKDFVEVYDKTVEESHLSEITVDALSILTEKVSKSRRLENLIAHYPAEKKNTLFGNLIALFLGLQPNFKTNFQLSEDAKLQFSKDTYEEDLEGLLGEVGDEYADLFASAKNLYDAILLSGILTVDDNSTKAPLSASMVKRYEEHQKDLKKFEDFIKVNALDQYNAIFKDKNKKGYAGYIESGVKQDEFYKYLKGILLQINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENAQIIEDIIQTLTLFEDREMIRQRLQKYSDIFTKAQLKKLERRHYTGWGRLSYKLINGIRNKENKKTILDYLIDDGYANRNFMQLINDDALSFKEEIAKAQIIGDVDDIANVVHDLPGSPAIKKGILQSVKIVDELVKVMGHNPANIIIEMARENQTTDRGRRNSQQRLKLLQDSLKNLDNPVNIKNVENQQLQNDRLFLYYIQNGKDMYTGETLDINNLSQYDIDHIIPQAYIKDDSFDNRVLTSSSENRGKSDNVPSIEVVCARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSTLIHQSITGLYETRIDLSKLGED

SEQ ID NO: 447 - protein, 1396 aa, Streptococcus anginosus
  Streptococcus anginosus SK52 = DSM 20563
MTKPYSIGLDIGTNSVGWAVITDDYKVPAKKMKVLGNTNRDYIKKNLLGALLFDGGETAEGRRLKRTARRRYTRRKNRLRYLQEIFAEEMMQVDESFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQANFKTNFQLSEDAKLQFSKDTYEEDLEGLLGEVGDEYADLFVSAKNLYDAILLSGILTVDDNSTKAPLSASMVKRYKEHKEELAAFKRFIKEKLPKKYEEIFKDDTKNGYAGYVGADKKLRKRSGKLATEEEFYKYVKGILNKVEGADYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKELERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPTNIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGIKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSILIHQSITGLYETRIDLSKLGED

SEQ ID NO: 448 - protein, 1373 aa, Streptococcus bovis
  Streptococcus bovis ATCC 700338
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFQRLDESFLRWDDDNKKLGRYPIFGNKADVVKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYEEDLGELLGKIGDDYADLFTSAKNLYDAILLSGILIVDDNSTKAPLSASMIKRYVEHQEDLEKLKEFIKANKSELYHDIFKDKNKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 449 - protein, 1375 aa, Streptococcus canis
  Streptococcus canis FSL Z3-227
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGIKHRKRTTKLATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASATELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 450 - protein, 1345 aa, Streptococcus constellatus
  Streptococcus constellatus subsp. constellatus SK53
MGKPYSIGLDIGTNSVGWAVVTDDYKVPAKKMKVLGNTDKQSIKKNLLGALLFDSGETAEATRLKRTARRRYTRRKNRLRYLQEIFTGEMNKVDENFFQRLDDSFLVDEDKRGEHHPIFGNIAAEVKYHDDFPTIYHLRRHLADTSKKADLRLVYLALAHMIKFRGHFLYEGDLKAENTDVQALFKDFVEEYDKTIEESHLSEITVDALSILTEKVSKSSRLENLIAHYPTEKKNTLFGNLIALSLDLHPNFKTNFQLSEDAKLQFSKDTYEEDLEGFLGEVGDEYADLFASAKNLYDAILLSGILTVDDNSTKAPLSASMVKRYEEHQKDLKKLKDFIKVNAPDQYNAIFKDKNKKGYASYIESGVKQDEFYKYLKGILLKINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYEAFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIDDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWDPKKYGGFDSPVVAYSILVFADVEKGKSKKLRKVQDMVGITIMEKKRFEKNPVDFLEQRGYRNVRLEKIIKLPKYSLFELENKRRRLLASAKELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 451 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 452 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEEKPINASGVDAKAILSARLSKSKRLENLIAQLPGEKKNGLFGNLIALSLGLTPNFKSNFDLAEDAKLQLSKDTYDDDLDNLLAQIGNQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 453 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKILTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYTKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGMTLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 454 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 455 - protein, 1348 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASASELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 456 - protein, 1377 aa, Streptococcus equinus
  Streptococcus equinus ATCC 9812
MEKTYSIGLDIGTNSVGWAVITDDYKVPAKKMKVLGNTDKKYIKKNLLGALLFDSGETAEATRLKRAARRRYTRRKNRLRYLQEIFAKEMAKVDESFFQRLEESFLTDDDKTFDSHPIFGNKAEEDTYHQEFPTIYHLRKHLADSPEKVDLRLVYLALAHMIKFRGHFLIEGQLNAENTDVQKIFADFVGVYDRTFDDSHLSEITVDAASILTEKISKSRRLENLIKQYPTEKKNTLFGNLVALALGLQPNFKTNFKLSEDAKLQFSKDTYDEDLEELLGKIGDDYADLFTAAKNLYDAILLSGILTVDDNSTKAPLSASMIKRYEEHHEDLEKLKTFIKVNNFDKYHEIFKDKSKNGYAGYIENGVKQDIFYKHLKSIISEKNGGQYFLDKIEREDFLRKQRTFDNGSIPYQIHLQEMRTILRRQGEYYPFLKENQAKIEKILTFRIPYYVGPLARKNSRFAWAKYHSDEPITPWNFDEVVDKEKSAEKFITRMTLNDLYLPEEKVLPKHSYVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGDANRNFMQLINDDSLSFKTTIQEAQVVGDVDDIEAVVHDLPGSPAIKKGILQSVKIVDELVKVMGHNPQNIVIEMARENQITGYGRNRSNQRLKRLQDSLKEFGSDILSKKKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKRKFDNLTKAERGGLTETDKAGFIKRQLVETRQITKHVAQILDARFNTKCDENDKVIRDVKVITLKSSLVSQFRKEFKFYKVREINDYHHAHDAYLNAVVGTALLKKYPKLAPEFVYGEYKKYDVRKLVAKSSDNHSELGKATAKYFFYSNLMNFFKTEVKYADGRVFERPDIETNADGEVVWNKQRDFNIVRKVLSYPQVNIVKKVEVQTGGFSKESILPKGDSDKLIPRKTKKLQWETQKYGGFDSPTVAYSVLVVADVEKGKTRKLKTVKELVGISIMERSSFEENPVSFLEKKGYHNVQEDKLIKLPKYSLFEFEGGRRRLLASATELQKGNEVVLPQYMVNLLYHSQHVNNSHKPEHLNYVKQHKDEFKDIFNLIISIARINILKPKVVDNLINEFTEYGQEDISSLSESFINLLKFISFGAPGAFKFLKLDVKQSNLRYKSTTEALSATLIHQSVTGLYETRIDLSKLGEE

SEQ ID NO: 457 - protein, 1370 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 458 - protein, 1370 aa, Streptococcus gallolyticus; identical to SEQ ID NO: 457
  Streptococcus gallolyticus subsp. gallolyticus TX20005

SEQ ID NO: 459 - protein, 1371 aa, Streptococcus gallolyticus
MTEKNYSIGLDIGTNSVGWAVITDDYKVPAKKMKVLGNTDKKYIKKNLLGALLFDNGETAEATRLKRTARRRYTRRKNRLRYLQEIFAEEMAKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQIIKDAQIIGDIDDVTSVVRELPGSPAIKKGILQSVKIVDELVKVMGHNPDNIVIEMARENQTTNRGRNQSQQRLKKLQDSLKELGSNILNEEKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETRQITKHVAQILDSRFNTERDENDKVIRNVKVITLKSNLVSQFRKDFKFYKVREINDYHHAHDAYLNAVVGTALLKKYPKLAPEFVYGEYKKYDIRKFITSSGDKATAKYFFYSNLMNFFKRVIRYSNGKVVVRPVIECSKDTGEIAWNKQTDFEKVRRVLSYPQVNIVKKVETQTGGFSKESILPKGNSDKLIPRKTKKFRWDTPKYGGFDSPNIAYSVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 460 - protein, 1130 aa, Streptococcus gallolyticus
MTNGKILGLDIGIASVGVGIIEAKTGKVVHANSRLFSAANAENNAERRGFRGSRRLNRRKKHRVKRVRDLFEKYEIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCSFYPDEYRASKASYTAQEYNFLNDLNNLKVPTETGKLSTEQKEALVEFAKSTATLGPAKLLKEIAKILDCKVDEIKGYREDDKGKPDLHTFEPYRKLKFNLDSVNIDDLSREVLDKLADILTLNTEREGIEDAIRHNLPNQFTEGQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNGTDKLPDEVFHGNKQLETKIRLWYQQGERCLYSGKPIPIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKISVIRGQFTSQLRRKWKIDKSRETYHHHAVDALIIAASSQLKLWEKQDNPMFVDYGNNQVVDKQTGEILSVSDDEYKELVFQPPYQGFVNMISSKGFEDEILFSYQVDSKYNRKVSDATIYSTRKAKIGKDKKEETYVLGKIKDIYSQNGFDTFIKKYNKDKTQFLMYQKDPLTWENVIEVILRDYPTTKKSEDGKNDVKCNPFEEYRRENGLVCKYSKKGKGTPIKSLKYYDKKLGNCIDITPEGSKNEVVLQSLNPWRADVYFNPETLKYELLGLKYSDLSFEKGTGKYHISQEKYDVIKEKEGIGKKSEFKFTLYRNDLILIKDTASGEQEIYRFLSRTMPNVKHYAELKPYDKEKFDNVQELVEALGEADKVGRCIKGLNKSNLSIYKVRTDVLGNKYFVKKEGDKPKLDFKNNKK

SEQ ID NO: 461 - protein, 1136 aa, Streptococcus gordonii
MNGLVLGLDIGIASVGVGILEKDTGKIIHASSRLFPAATADNNVERRSNRQGRRLNRRKKHRSVRLQDLFEGYGLLTDFSKVSMNLNPYQLRVQGMENQLTNEELFVALKNIVKRRGISYLDDASEDGGTVSSDYGKAVEENRKLLAEKTPGQIQLERFEKYGQLRGDFTVEENGEKHRLINVFSTSAYRKEAERILRKQQEFNSKITDEFIEDYLIILTGKRKYYHGPGNEKSRTDYGRFRTDGTTLDNIFGILIGKCTFYTEEYRASKASYTAQEFNLLNDLNNLTVPTETKKLSEEQKKLIIEYAKSAKTLGASTLLKYIAKMIDASVDQIRGYRVDVNNKPEMHTFEVYRKMQSLETIKVEELPRKVLDELAHILTLNTEREGIEEAINSKLKDIFNRDQVLELVQFRKNNSSLFSKGWHNFSIKLMMELIPELYETSEEQMTILTRLGKQRSKETSKRTKYIDEKELTEEIYNPVVAKSVRQAIKIINEATKKYGIFDNIVIEMARENNEEDAKKDYIKRQKANQDEKNAAMEKAAFQYNGKKELPDNIFHGHKELTTKIRLWHQQGEKCLYTGKNIPISDLIHNQYKYEIDHILPLSLSFDDSLSNKVLVLATANQEKGQRTPFQALDSMDDAWSYREFKSYVKDSKLLSNKKKDYLLTEEDISKIEVKQKFIERNLVDTRYSSRVVLNALQDFYKSHQLDTTISVVRGQFTSQLRRKWGIEKSRETYHHHAVDALIIAASSQLRLWKKHSNPLIAYKEGQFVDSETGEIVSLSDEEYKELVFKAPYDHFVDTLRSKKFEDSILFSYQVDSKYNRKISDATIYATRKAKLDKEKKEYTYTLGKIKDIYALGTKTPSKTGFYKFLDLYKTDKSQFLMYQKDRKTWDEVIEKIIEQYRPFKEYDKNGKEVDFNPFEKYRIGNGPIRKYSKKGNGPEIKSLKYYDILLGKHKNITPDGSRNTVALLSLNPWRTDVYYNSETKKYEFLGLKYADLCFEEGGAYGISEVKYKKIREKEGIGKNSEFKFTLYKNDLILIKDTETNCQQFFRFWSRTGKDNPKSFEKHKIELKPYEKAKFEKGEELKVLGKVPPSSNQFQKNMQIENLSIYKVKTDILGNKHFIKKEGDEPKLKFKK

SEQ ID NO: 462 - protein, 1129 aa, Streptococcus infantarius
  Streptococcus infantarius subsp. infantarius ATCC BAA-102
MSNGKILGLDIGVASVGVGIIDSKTGNVIHANSRLFSAANAENNAERRGFRGARRLTRRKKHRVKRVRDLFEKYDISTDFRNLNLNPYELRVKGLTEQLTNEELFAALRTIAKRRGISYLDDAEDDSTGSSDYAKSIDENRRLLKTKTPGQIQLERLEKYGQLRGNFTVYDENGEAHRLINVFSTSDYKNEARKILETQSNYNKQITDEFIEDYIEILTQKRKYYHGPGNEKSRTDYGRFRTDGTTLENIFGILIGKCSFYPEEYRASKASYTAQEFNFLNDLNNLKVPTETGKLSTEQKEYLVDFAKKSKALGASKLLKEIAKIVDCSVDDIKGYRVDNKDKPDLHTFEPYRKLKFNLSSIDIDELSRETLDKLADILTLNTEREGIEDAIKRNLPSQFTEEQISEIVQIRKNQSSAFNKGWHSFSAKLMNELIPELYVTSEEQMTILTRLEKFKVNKKSSKNTKTIDEKEITDEIYNPVVAKSVRQTIKIINAAVKKYGDFDKIVIEMPRDKNAEDEKKFIDKKQKENKKEKDDSLKRAAFLYNGTDNLPDGVFHGNKELKTKIRLWYQQGERCLYSGKLISIHDLVHNSNKFEIDHILPLSLSFDDSLANKVLVYAWTNQEKGQKTPYQVIDSMDTAWSFREMKDYVLKQKGLGKKKCEYLLTTENIDKIEVKKKFIERNLVDTRYASRVVLNSLQTALKELGKDTKVSVVRGQFTSQLRRKWNIDKSRETYHHHAVDALIIAASSQLKLWQKQENPMFESYGENQVVNKETGEILSISDDKYKELVFQPPYQGFVNTISSKGFEDEILFSYQVDSKFNRKVSDATIYSTRKAKLGKDKKDETYVLGKIKDIYSQDGFDTFIKRYKKDKTQFLMYQKDPLTWENVIEVILRDYPSEKLSEDGKKTVKCNPFEEYRRENGLICKYSKKGNGTPIKSLKYYDKKLGNCIDITPEKSKNRVVLRQISPWRADIYFNLETLKYELMGLKYSDLSFEKGTGKYHISQEKYDAIREKEGIGKKSEFKFTLYRNDLILIKDTLNNCERMLRFGSKNDTSKHYVELKPLEKGTFDSEEEILPVLGKVAKSGQFIKGLNKPNISIYKVRTDVLGNKFFIKKEGDKPKLDFKNNNK

SEQ ID NO: 463 - protein, 1375 aa, Streptococcus infantarius
MEKSYSIGLDIGTNSVGWAVITDDYKVPAKKMKVLGNTDKKYIKKNLLGALLFDSGETAEVTRLKRTARRRYTRRKNRLRYLQEIFAKEMTKVDESFFQRLEESFLTDDDKTFDSHPIFGNKAEEDAYHQKFPTIYHLRKYLADSQEKADLRLVYLALAHMIKYRGHFLIEGELNAENTDVQKLFNVFVETYDKIVDESHLSEIEVDASSILTEKVSKSRRLENLIKQYPTEKKNTLFGNLIALALGLQPNFKTNFKLSEDAKLQFSKDTYEEDLEELLGKVGDDYADLFISAKNLYDAILLSGILTVDDNSTKAPLSASMIKRYVEHHEDLEKLKEFIKINKLKLYHDIFKDKTKNGYAGYIDNGVKQDEFYKYLKTILTKIDDSDYFLDKIERDDFLRKQRTFDNGSIPHQIHLQEMHSILRRQGDYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNGQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTGYGRNKSNQRLKRLQDSLKEFGSDILSKKKPSYVDSKVENSHLQNDRLFLYYIQNGKDMYTGEELDIDRLSDYDIDHIIPQAFIKDNSIDNKVLTSSAKNRGKSDDVPSIEIVRNRRSYWYKLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVRKLIAKSSDDYSEMGKATAKYFFYSNLMNFFKTEVKYADGRVFERPDIETNADGEVVWNKQKDFDIVRKVLSYPQVNIVKKVEAQTGGFSKESILSKGDSDKLIPRKTKKVYWNTKKYGGFDSPTVAYSVLVVADIEKGKAKKLKTVKELVGISIMERSFFEENPVSFLEKKGYHNVQEDKLIKLPKYSLFEFEGGRRRLLASATELQKGNEVMLPAHLVELLYHAHRIDSFNSTEHLKYVSEHKKEFEKVLSCVENFSNLYVDVEKNLSKVRAAAESMTNFSLEEISASFINLLTLTALGAPADFNFLGEKIPRKRYTSTKECLSATLIHQSVTGLYETRIDLSKLGEE

SEQ ID NO: 464 - protein, 1368 aa, Streptococcus iniae
  Streptococcus iniae 9117
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 465 - protein, 1338 aa, Streptococcus macacae
  Streptococcus macacae NCTC 11558
MTKPYSIGLDIGTNSVGWAVVTDGYKVPAKKMKVLGNTDKSHIKKNLLGALLFDSGNTAKDRRLKRTARRRYTRRRNRILYLQEIFAEEMAKADESFFQRLNESFLTNDDKEFDSHPIFGNKAEEEAHHHKFPTIFHLRKHLADSTEKSDLRLIYLALAHMIKFRGHFLIEGQLKAENTNVQTLFDDFVEVYDKTVEESHLSEISVSSILTEKISKSRRLENLIKYYPTEKKNTLFGNLIALSLGLQPNFKTNFKLSEDAKLQFSKDTYEEDLGELLGKIGDNYADLFISAKNLYDAILLSGILTIDDNTTKAPLSASMIKRYEEHQEDLAQLKKFIRQNLPDQYSEVFSDKTKDGYAGYIDGKTNQEAFYKYIKNMLSKTEGADYFLDKIDREDFLRKQRTFDNGSVPHQIHLQEMHAILRRQGEYYPFLKENQDKIEKILTFRIPYYVGPLARKGSRFAWAEYKADKKVTPWNFDDILDKEKSAEEFITRMTLNDLYLPEEKVLPKHSLVYETFNVYNELTKVKYVNEQGKAIFFDANMKQEIFDHVFKENRKVTKDKLLNYLNKEFEEFRIVNLTGLDKENKAFNSSLGTYHDLRKILDKSFLDDKVNEKIIEDIIQTLTLFEDREMIRQRLQKYSDIFTTQQLKKLERRHYTGWGRLSAKLINGIRDKQSNKTILGYLIDDGYSNRNFMQLINDDSLPFKEEIARAQVIGETDDLNQLVSDIAGSPAIKKGILQSLKIVDELVKVMGHNPANIVIEMARENQTTAKGRRSSQQRYKRLEEAIKNLDHDLNHKILKEHPTDNQALQNDRLFLYYLQNGRDMYTEDPLDINRLSDYDIDHIIPQSFIKDDSIDNKVLVSSAKNRGKSDNVPSEDVVNRMRPFWNKLLSCGLISQRKYSNLTKKELKPDDKAGFIKRQLVETRQITKHVAQILDARFNTKRDENKKVIRDVKIITLKSNLVSQFRKDFKFYKVREINDYHHAHDAYLNAVIGKALLDVYPQLEPEFVYGEYPHFHGYKENKATAKKFFYSNIMNFFKKDDIRTDENGEIVWKKDEHISNIKRVLSYPQVNIVKKVEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 466 - protein, 1130 aa, Streptococcus macedonicus
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVPTETGKLSTEQKESLVEFAKNTAILGPAKLLKEIAKILDCKVDEIKGYREDDKGKPDLHTFEPYRKLKFNLDSVNIDYLSREVLDKLADILTLNTEREGIEDAIKRNLPNQFTEEQISEIINVRKSQSTAFNKGWHSFSAKLMNELIPELYATSDEQMTILTRLEKFKVKKKSSKNIKTIDEKEITDEIYNPVVAKSVRQTIKIINAAVKKYGDFDKIVIEMPRDKNADDEKKFINKRNKENKKEKDDALKRAAYLYNGTDKLPDEVFHGNKQLETKIRLWYQQGERCLYSGKPIPIQELVHNSNNFEIDHILPLSLSFDDSLANKVLVYSWTNQEKGQKTPYQVIDSMDAAWSFREMKEYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGNNQVVDKQTGEILSVSDNEYKELVFQPPYQGFVNTISSKGFEDEILFSYQVDSKYNRKVSDATIYSTRKAKIGKDKKEETYVLGKIKDIYSQNGFDTFVKKYNKDKTQFLMYQKDPLTWENVIEVILGDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKSLNKPNISIYKVRTDVLGNKYFVKKEGDKPKLDFKNNKK

SEQ ID NO: 467 - protein, 1134 aa, Streptococcus mitis
  Streptococcus mitis ATCC 6249
MNGLVLGLDIGIASEGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKLRLINVFSTSAYKKEAERILRKQQEFNNQITDEFIEDYLKILTGKRKYYHGPGNEKSRTDYGRFRTDGTTLDNIFGILIGKCTFYPEEYRASKASYTAQEFNLLNDLNNLTVPTETKKLSEEQKKVIVEYAKEAKTLGASTLLKYIAKMIDASVDQIRGYRVDVNNKPEMHTFEVYRKMQSLETISVGELSRNVLDELAHILTLNTEREGMEEAINTKLKDSFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPDNIFHGHKELATKIRLWHQQGEKCLYTGKTIPISDLIYNQYKYEIDHILPLSLSFDDSLSNKVLALATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFVDSQTGEIISLTDDEYKELVFKAPYDHFVDTLSSKTFEDSILFSYQVDSKFNRKISDATIYATRKAKLDKEKKEYTYTLGKIKDIYSLGTKTPSKTGFYKFLDLYNKDKSQFLMFQKDRKTWDEVIEKIMEQYRPFKEYDKTGKLVDFNPFEKYRQENEPIRKYSKKGNGPEIKSLKYYDILLGKHKNITPEGSRNTVALLSLNPWRTDVYYNMETKKYEFLGLKYADLPFEEGGAYGISTETYNELREKEGIGKNSEFKFTLYKNDLILIKDTETNCQQIFRFWSRTGKDNPKSFEKHKIELKPYEKARFEKGEELEVLGKVPPSSNQLQKNMQIENLSIYKVKTDVLGNKHFIKKEGDKPKLKF

SEQ ID NO: 468 - protein, 1392 aa, Streptococcus mitis
  Streptococcus mitis SK321
MNNNNYSIGLDIGTNSVGWAVITDDYKVPSKKMKVLGNTDKHFIKKNLIGALLFDEGATAEDRRFKRTARRRYTRRKNRLRYLQEIFSEEMSKVDSSFFHRLDDSFLVPEDKRGSKYPIFATLAEEKEYHKKFPTIYHLRKHLADSKEKTDLRLIYLALAHMIKYRGHFLYEESFDIKNNDIQKIFSEFISIYDNTFEGSSLSGQNAQVEAIFTDKISKSAKRERILKLFAYEKSTDLFSEFLKLIVGNQADFKKHFDLEEKAPLQFSKDTYDEDLENLLGQIGDDFADLFLVAKKLYDAILLSGILTVTDSSTKAPLSASMIERYENHQKDLAALKQFIQNNLQEKYDEVFSDQSKDGYARYINGKTTQEAFYKYIKNLLSKFEGSDYFLDKIEREDFLRKQRTFDNGSIPHQIHLQEMNAIIRRQGEHYPFLKEYKEKIETILTFRIPYYVGPLARGNRNFAWLTRNSDQAIRPWNFEEIVDQASSAEEFINKMTNYDLYLPEEKVLPKHSLLYETFAVYNELTKVKFISEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYASIFDKKVIKALTRRHYTGWGKLSAKLINGICDKKTGKTILDYLIDDGYSNRNFMQLINDDGLSFKDIIQKAQVVGKTNDVKQVVQELPGSPAIKKGILQSIKLVDELVKVMGHAPESIVIEIARENQTTARGKKNSQQRYKRIEDALKNLAPGLDSNILKEHPTDNIQLQNDRLFLYYLQNGKDMYTGEALDINQLSSYDIDHIVPQAFIKDDSLDNRVLTSSKDNRGKSDNVPSLEVVQKRKAFWQQLLDSKLISEHKFNNLTKAERGGLDERDKVGFIRRQLVETRQITKHVAQILDARFNTEVNEKDKKNRTVKIITLKSNLVSNFRKEFKLYKVREINDYHHAHDAYLNAVVAKAILKKYPKLEPGFVYGDYQKYDIKRYISRSKDPKEVEKATEKYFFYSNLLNFFKEEVHYADGTIVKRENIEYSKDTGEIAWNKEKDFATIKKVLSLPQVNIVKKTEIQTHGLDRGKPRGLFNSNPSPKPSEDRKENLVPIKQGLDPRKYGGYAGISNSYAVLVKAIIEKGAKKQQKTVLEFQGISILDKINFEKNKENYLLEKGYIKILSTITLPKYSLFEFPDGTRRRLASILSTNNKRGEIHKGNELVIPEKYTTLLYHAKNINKTLEPEHLEYVEKHRNDFAKLLEYVLNFNDKYVGALKNGERIRQAFIDWETVDIEKLCFSFIGPRNSKNAGLFELTSQGSASDFEFLGVKIPRYRDYTPSSLLNATLIHQSITGLYETRIDLSKLGED

SEQ ID NO: 469 - protein, 1345 aa, Streptococcus mutans
  Streptococcus mutans 11SSST2
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLTQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 470 - protein, 1345 aa, Streptococcus mutans; identical to SEQ ID NO: 469
  Streptococcus mutans 11SSST2

SEQ ID NO: 471 - protein, 1345 aa, Streptococcus mutans
  Streptococcus mutans 11VS1
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 472 - protein, 1345 aa, Streptococcus mutans
  Streptococcus mutans 14D
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 473 - protein, 1355 aa, Streptococcus mutans
  Streptococcus mutans 15VF2
MKKSYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVMPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLNKLGGD

SEQ ID NO: 474 - protein, 1355 aa, Streptococcus mutans; identical to SEQ ID NO: 473
  Streptococcus mutans 15VF2

SEQ ID NO: 475 - protein, 1345 aa, Streptococcus mutans
  Streptococcus mutans 1SM1
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 476 - protein, 1345 aa, Streptococcus mutans; identical to SEQ ID NO: 475
  Streptococcus mutans 1SM1

SEQ ID NO: 477 - protein, 1350 aa, Streptococcus mutans
  Streptococcus mutans 24
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTLDDKAGFIKRQLVETRQITKHVARMLDERFNKEFDDNNKRICKVKIVTLKSNLVSSFRKEFELYKVREINDYHHAHDAYLNAVVVKALLVKYSKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 478 - protein, 1350 aa, Streptococcus mutans; identical to SEQ ID NO: 477
  Streptococcus mutans 24

SEQ ID NO: 479 - protein, 1345 aa, Streptococcus mutans; identical to SEQ ID NO: 472
  Streptococcus mutans 2VS1

SEQ ID NO: 480 - protein, 1345 aa, Streptococcus mutans; identical to SEQ ID NO: 472
  Streptococcus mutans 2VS1

SEQ ID NO: 481 - protein, 1345 aa, Streptococcus mutans; identical to SEQ ID NO: 471
  Streptococcus mutans 3SN1

SEQ ID NO: 482 - protein, 1345 aa, Streptococcus mutans; identical to SEQ ID NO: 471
  Streptococcus mutans 3SN1

SEQ ID NO: 483 - protein, 1345 aa, Streptococcus mutans
  Streptococcus mutans 4SM1
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 484 - protein, 1345 aa, Streptococcus mutans; identical to SEQ ID NO: 483
  Streptococcus mutans 4SM1

SEQ ID NO: 485 - protein, 1345 aa, Streptococcus mutans
  Streptococcus mutans 4VF1
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDRNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 486 - protein, 1345 aa, Streptococcus mutans; identical to SEQ ID NO: 485
  Streptococcus mutans 4VF1

SEQ ID NO: 487 - protein, 1345 aa, Streptococcus mutans
  Streptococcus mutans 5SM3
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDFFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQSEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGETAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 488 - protein, 1345 aa, Streptococcus mutans; identical to SEQ ID NO: 487
  Streptococcus mutans 5SM3

SEQ ID NO: 489 - protein, 1359 aa, Streptococcus mutans
  Streptococcus mutans 66-2A
MKKPYSIGLDIGTNSVGWAVVTDDYKVPAKKMKVLGNTDKSHIKKNLLGALLFDSGNTAEDRRLKRTARRRYTRRRNRILYLQEIFAEEMMQVDESFFQRLDDSFLVEEDKRGSRYPIFGTLKEEKKYHKEFKTIYHLREKLANSTEKADLRLVYLSLAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYKEHKEELAAFKRFIKEKLPKKYEEIFKDDTKNGYAGYVGADKKLRKRSGKLATEEEFYKYVKGILNKVEGADVWLDKIDREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENEQIIEDIIQTLTLFEDREMIRQRLQKYSDIFTKAQLKKLERRHYTGWGRLSYKLINGIRDKQSNKTILGYLIDDGYSNRNFMQLINDDALSFKEEIAKAQVIGEMDGLNQVVSDIAGSPAIKKGILQSLKIVDELVKVMGHNPANIVIEMARENQTTAKGRRSSQKRYKRLEEAIKNLDHDLNHKILKEHPTDNQALQNDRLFLYYLQNGRDMYTEDPLDINRLSDYDIDHIIPQAFIKDNSIDNRVLTRSDKNRGKSDDVPSEEVVHKMKPFWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKGDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLETLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLNKLGGD

SEQ ID NO: 490 - protein, 1359 aa, Streptococcus mutans; identical to SEQ ID NO: 489
  Streptococcus mutans 66-2A

SEQ ID NO: 491 - protein, 1345 aa, Streptococcus mutans
  Streptococcus mutans 8ID3
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELIKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 492 - protein, 1345 aa, Streptococcus mutans; identical to SEQ ID NO: 491
  Streptococcus mutans 8ID3

SEQ ID NO: 493 - protein, 1345 aa, Streptococcus mutans
  Streptococcus mutans A19
MKKPYSIGLDIGTNSVGWSVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRIDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 494 - protein, 1345 aa, Streptococcus mutans; identical to SEQ ID NO: 493
  Streptococcus mutans A19

SEQ ID NO: 495 - protein, 1345 aa, Streptococcus mutans; identical to SEQ ID NO: 472
  Streptococcus mutans B

SEQ ID NO: 496 - protein, 1345 aa, Streptococcus mutans; identical to SEQ ID NO: 472
  Streptococcus mutans G123

SEQ ID NO: 497 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 498 - protein, 1345 aa, Streptococcus mutans
MKKPYSIGLDIGTNSVGWAVVTDDYKVPDKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 499 - protein, 1345 aa, Streptococcus mutans
  Streptococcus mutans M21
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 500 - protein, 1345 aa, Streptococcus mutans; identical to SEQ ID NO: 499
  Streptococcus mutans M21

SEQ ID NO: 501 - protein, 1345 aa, Streptococcus mutans
  Streptococcus mutans M230
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 502 - protein, 1345 aa, Streptococcus mutans; identical to SEQ ID NO: 501
  Streptococcus mutans M230

SEQ ID NO: 503 - protein, 1345 aa, Streptococcus mutans
  Streptococcus mutans M2A
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSYKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 504 - protein, 1345 aa, Streptococcus mutans; identical to SEQ ID NO: 503
  Streptococcus mutans M2A

SEQ ID NO: 505 - protein, 1345 aa, Streptococcus mutans
  Streptococcus mutans N29
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 506 - protein, 1345 aa, Streptococcus mutans; identical to SEQ ID NO: 505
  Streptococcus mutans N29

SEQ ID NO: 507 - protein, 1345 aa, Streptococcus mutans
  Streptococcus mutans N3209
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGCFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 508 - protein, 1345 aa, Streptococcus mutans; identical to SEQ ID NO: 507
  Streptococcus mutans N3209

SEQ ID NO: 509 - protein, 1345 aa, Streptococcus mutans
  Streptococcus mutans N66
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 510 - protein, 1345 aa, Streptococcus mutans; identical to SEQ ID NO: 509
  Streptococcus mutans N66

SEQ ID NO: 511 - protein, 1350 aa, Streptococcus mutans
  Streptococcus mutans NFSM1
MKKPYSIGLDIGTNSVGWAVVTDDYKVPAKKMTVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKTPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 512 - protein, 1350 aa, Streptococcus mutans; identical to SEQ ID NO: 511
  Streptococcus mutans NFSM1

SEQ ID NO: 513 - protein, 1345 aa, Streptococcus mutans; identical to SEQ ID NO: 485
  Streptococcus mutans NLML1

SEQ ID NO: 514 - protein, 1338 aa, Streptococcus mutans
  Streptococcus mutans NLML4
MDLIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 515 - protein, 1338 aa, Streptococcus mutans; identical to SEQ ID NO: 514
  Streptococcus mutans NLML4

SEQ ID NO: 516 - protein, 1128 aa, Streptococcus mutans
  Streptococcus mutans NLML5
MANSKILGLDIGIASVGVGIIDKETGKIIHVNSRIFPAATADSNVERRGFRQGRRLVRRKKHRKVRLADLFLDSNLLTDFSKVSLNLNPYQLRVKGLNEELSNEELFIALKSIVSRRGISYLDDASEDSGANSSEYGKAVEENRKLLEDRTPGQIQLERFEKYGKVRGDFTVVENGENHRLINVFSTSAYKKEAERILRRQQEFNIRIADEFIEAYLTILTGKRKYYHGPGNEKSRTDYGRFRTDGTTLDNIFGILIGKCTFYPDEYRAAKASYTAQEFNLLNDLNNLTVPTETKKLSEEQKRQIIEHAKTVKTLGAPTLLKYIAKLVGCSADDIKGYRIDKSDKPEIHTFEAYRKMRTMELIKVADLSRESLDALAHILTLNTEREGIEEAIRDRFTNKEFNQEQINELVLFRKNNSSLFGKGWHNFSLKLMKELIPELYETSEEQMTILTRLGKQRVKKSSNRTNYIDEKELTEEIYNPVVAKSVRQAIKIINLATKKYGVFDNIVIEMARESNEDDEKKAIQNAQKANEDEKEAALLKAAHQFNGKEELPDSIFHGHKELLTKIRLWHQQGEKCLYTGKTIFINDLIHNPYKYEIDHILPLSLSFDDSLANKVLVLSTANQEKGQRTPFQSLDSMDGAWTYREFKAYVKGLKTLSNKKKDYLLNEEDINKNEVKQKFIERNLVDTRYSSRVVLNTLQDFYKKREFDTKISVVRGQFTSQIRRKWRIEKTRETYHHHAVDALIIAASSQLNLWKKQNNPLISYKEDQFVDPETGEILSLSDDEYKELVFKAPYDHFVDTLKSKKFEDSILFSYQVDSKYNRKISDATIYGTRKARLGKDSQEETYVLGKIKDIYSQKGYEDFIKKYKKDKTQFLMYHKDPQTFEKVIEEILKTYSDKELNEKGKEVPCNPFEKYRQENGPVRKYSKKGNGPEIKSIKYYDNKLGNHIDITPNNSHHQVVLQSLKPWRTDVYFNPKSGKYELMGLKYSDLRFEKVSGDYGISVKKYNEIKSKEGVDENSEFKFTLYKNDLILIKDTESGEQELFRFLSRTMPNQKHYVELKPYDKSKFEGHQKLMDIFGEVAKGGQCLKGLNKSNISIYKVKTDVLGNKYFIKKEGDQPQLNFKKKI

SEQ ID NO: 517 - protein, 1128 aa, Streptococcus mutans; identical to SEQ ID NO: 516
  Streptococcus mutans NLML5

SEQ ID NO: 518 - protein, 1125 aa, Streptococcus mutans
  Streptococcus mutans NLML8
MTNGKILGLDIGIASVGVGIINAKTGNVEHASSRIFPAANADNNVERRSARGGRRLIRRKKHRLKRVEDLFEKYNIDTDFSNLNLNPYQLRVKGLNEQLSNEELFAILKNIAKRRGISYLDDAEDDSVGSSDYAKAIDENRKLLKKQTPGEIQLKRLEKYGQLRGNFTIQDENGEYHRLINVFSTSDYVKEARRILETQSYYNKFITESFVEDYIKILQGKRKYYVGPGNEKSRTDYGIYRTDGETLDNLFGILIGKCGFYPEEYRAAKASYTAQEYNFLNDLNNLTVPTETKKLSTEQKYQLVDFAKTASTLEAAKLLKEIAKLVGCQVEEIKGYRLDNKDKPDLHTFEPFRKLKSNLTTIAVENLSITTLDTLAHILTLNTEREGIEEAIQKELPNIFSDEQITGIIAVRKKNSQIFGKGWHSFSIKLMKELIPELYETSEEQMTILIRLKKVKTNSKITNRTKYINEQEVTDEIYNPVVSKSIRQTVKIINAAIKKYGAFDQIVIEMPRESNEEDERKFIADLQKSNAKEKDDAMKQAALLYNGKAELPHGVFHGHKELATKIRLWYQQGERCLYSGKHIDIHDLIHNQHMFEIDHVLPLSLSFDDSLANKVLVYSWANQEKGQRTPFQALPQMASAWSFRELRDYISKQKGISKKKRDYLLTEQDINKVEVKQKFIERNLVDTRYVSRVVLNTLQDALKVMNKETKISVIRGQFTSQLRRQWRIDKSRETYHHHAVDALIIAASSQLRLWKKQNNPMFAEDKHGQKINLDTGEVLSDDAYKELVYQAPYQGFVNTISSKSFEDEILFSYQVDSKVNRKISDATIYATRQAQLGKDKKEETYVLGKIKDIYSQAGYDAFRKKYDKDKAVFLMYQKDPETWEKVIEVILRDYKELDDKGKEIGNPFERYKVKHGFVRKYSRKNKGTEIKSLKYYDNKLGNHIDITPNNSKHSVVLQSINPWRADLYFNPETTKYELMGLKYADLSFEKGTGKYSISREKYDEIKEREGISSKSEFKFTLYKNDLILVKDIGNHKELIARFNSKNDTSKHYVELKPWNKAKFDSEEELIPAFGKVAKSGQFIKGLNKPDLSIYKVKTDILGHKYYIKKEGDKPKLNFENKIKNK

SEQ ID NO: 519 - protein, 1125 aa, Streptococcus mutans; identical to SEQ ID NO: 518
  Streptococcus mutans NLML8

SEQ ID NO: 520 - protein, 1345 aa, Streptococcus mutans
  Streptococcus mutans NLML9
MKKPYSIGLDIGTNSVGWAVVTDDYKVSAKKMKVLGNTDKSHIKKNLLGALLFDSGNTAEDRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHTHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 521 - protein, 1345 aa, Streptococcus mutans; identical to SEQ ID NO: 520
  Streptococcus mutans NLML9

SEQ ID NO: 522 - protein, 1355 aa, Streptococcus mutans
  Streptococcus mutans NMT4863
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLLPCMEATLIHQSITGLYETRIDLSKLGGD

SEQ ID NO: 523 - protein, 1355 aa, Streptococcus mutans; identical to SEQ ID NO: 522
  Streptococcus mutans NMT4863

SEQ ID NO: 524 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVKHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 525 - protein, 1345 aa, Streptococcus mutans; identical to SEQ ID NO: 471
  Streptococcus mutans NV1996

SEQ ID NO: 526 - protein, 1345 aa, Streptococcus mutans
  Streptococcus mutans NVAB
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 527 - protein, 1345 aa, Streptococcus mutans; identical to SEQ ID NO: 526
  Streptococcus mutans NVAB

SEQ ID NO: 528 - protein, 1345 aa, Streptococcus mutans
  Streptococcus mutans R221
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 529 - protein, 1345 aa, Streptococcus mutans; identical to SEQ ID NO: 528
  Streptococcus mutans R221

SEQ ID NO: 530 - protein, 1345 aa, Streptococcus mutans
  Streptococcus mutans S1B
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSYPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFRNLVALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 531 - protein, 1345 aa, Streptococcus mutans; identical to SEQ ID NO: 530
  Streptococcus mutans S1B

SEQ ID NO: 532 - protein, 1345 aa, Streptococcus mutans; identical to SEQ ID NO: 471
  Streptococcus mutans SF1

SEQ ID NO: 533 - protein, 1345 aa, Streptococcus mutans
  Streptococcus mutans SF14
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVNDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 534 - protein, 1345 aa, Streptococcus mutans; identical to SEQ ID NO: 533
  Streptococcus mutans SF14

SEQ ID NO: 535 - protein, 1345 aa, Streptococcus mutans
  Streptococcus mutans SM1
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 536 - protein, 1345 aa, Streptococcus mutans; identical to SEQ ID NO: 535
  Streptococcus mutans SM1

SEQ ID NO: 537 - protein, 1345 aa, Streptococcus mutans
  Streptococcus mutans SM4
MKKPYSIGLDIGTNSVGWAVVTDDYKVPAKKMKVLGNTDKSHIKKNLLGALLFDSGNTAEDRRLKRTARRRYTRRRNRILYLQEIFSEEMDKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 538 - protein, 1345 aa, Streptococcus mutans; identical to SEQ ID NO: 537
  Streptococcus mutans SM4

SEQ ID NO: 539 - protein, 1345 aa, Streptococcus mutans
  Streptococcus mutans SM6
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFGGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 540 - protein, 1345 aa, Streptococcus mutans; identical to SEQ ID NO: 539
  Streptococcus mutans SM6

SEQ ID NO: 541 - protein, 1134 aa, Streptococcus mutans
  Streptococcus mutans ST1
MANGKILGLDIGIASVGVGIIDKETGKIIHVNSRIFPAATADSNVERRGFRQGRRLVRRKKHRKVRLADLFLDSNLLTDFSKVSLNLNPYQLRVKGLNEELSNEELFIALKSIVSRRGISYLDDASEDSGANSSEYGKAVEENRKLLEDRTPGQIQLERFEKYGKVRGDFTVVENGENHRLINVFSTSAYKKEAERILRRQQEFNMRIADEFIEAYLTILTGKRKYYHGPGNEKSRTDYGRFRTDGTTLDNIFGILIGKCTFYPDEYRAAKASYTAQEFNLLNDLNNLTVPTETKKLSEEQKRQIIEHAKTVKTLGAPTLLKYIVKLVGCSADDIKGYRIDKSDKPEIHTFEAYRKMRTMELIKVDDLSRESLDALAHILTLNTEREGIEEAIRDRFTNKEFNQEQINELVLFRKNNSSLFGKGWHNFSLKLMKELIPELYETSEEQMTILTRLGKQRVKKSSNRTNYIDEKELTEEIYNPVVAKSVRQAIKIINLATKKYGVFDNIVIEMARESNEDDEKKAIQNAQKANEDEKKAALLKAAHQFNGKEELPDSIFHGHKELLTKIRLWHQQGEKCLYTGKTIFINDLIHNPYKYEIDHILPLSLSFDDSLANKVLVLSTANQEKGQRTPFQSLDSMDGAWTYREFKSYVKGLKTLSNKKKDYLLTEENIDKIEVKQKFIERNLVDTRYSSRVVLNALQDFYKERKFDTKISVVRGQFTSQLRRKWRIEKTRETYHHHAVDALIIAASSQLNLWKKQNNPLISYKEDQFVDPETGEILSLSDDEYKKLVFKAPYEHFVDTLKSKKFEDSILFSYQVDSKYNRKISGATICGTRKAQLGKDTQEETYVLGKIKDIYSQKGYEDFIKKYKKDKTQFLMYHKDPQTFEKVIEEILKTYPDKELNEKGKEVSCNPFEKYRQENGPVRKYSKKGNGPEIKSLKYYDEVLGKNIDITPKNSLNKVVLRSLNPWRTDVYFNHETRKYEFLGLKYSDLRYLKGEHRYGILIGDYKKIKDKEGIEKESEFKFTLYKNDLILIKDTAKGKEELFRFWSRTGKDNAKTFEKNKIELKPYSKSQFEKGEDTNVLGKLYASSNQLQKSFGTLENLSIYKVRTDVLGNKYFIKKEGDKPQLNFKKKL

SEQ ID NO: 542 - protein, 1134 aa, Streptococcus mutans; identical to SEQ ID NO: 541
  Streptococcus mutans ST1

SEQ ID NO: 543 - protein, 1350 aa, Streptococcus mutans
  Streptococcus mutans ST6
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYSFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTLDDKAGFIKRQLVETRQITKHVARMLDERFNKEFDDNNKRIRKVKIVTLKSNLVSSFRKEFELYKVREINDYHHAHDAYLNAVVVKALLVKYSKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 544 - protein, 1350 aa, Streptococcus mutans; identical to SEQ ID NO: 543
  Streptococcus mutans ST6

SEQ ID NO: 545 - protein, 1125 aa, Streptococcus mutans
  Streptococcus mutans U2A
MTNGKILGLDIGIASVGVGIINAKTGNVEHASSRIFPAANADNNVERRSARGGRRLIRRKKHRLKRVEDLFEKYNIDTDFSNLNLNPYQLRVKGLNEQLSNEELFAILKNIAKRRGISYLDDAEDDSVGSSDYAKAIDENRKLLKKQTPGEIQLKRLEKYGQLRGNFTIQDENGEYHRLINVFSTSDYVKEARRILETQSYYNKFITESFVEDYIKILQGKRKYYVGPGNEKSRTDYGIYRTDGETLDNLFGILIGKCGFYPEEYRAAKASYTAQEYNFLNDLNNLTVPTETKKLSTEQKYQLVDFAKTASTLGAAKLLKEIAKLVGCQVEEIKGYRLDNKDKPDLHTFEPFRKLKSNLTTIAVENLSITTLDTLAHILTLNTEREGIEEAIQKELPNIFSDEQITEIIAVRKKNSQIFGKGWHSFSIKLMKELIPELYETSEEQMTILTRLKKVKTNSKITNRTKYINEEEITDEIYNPVVSKSIRQTVKIINATIKKYGAFDQIIIEMPRESNEEDERKFIADLQKSNAKEKDDAMKQAALLYNGKDELPHDVFHGHKELATKIRLWYQQGERCLYSGKHIDIHDLIHNQHMFEIDHVLPLSLSFDDSLANKVLVYSWANQEKGQRTPFQALPQMASAWSFRELRDYISKQKGISKKKRDYLLTEQDINKVEVKQKFIERNLVDTRYVSRVVLNTLQDALKVMNKETKISVIRGQFTSQLRRQWRIDKSRETYHHHAVDALIIAASSQLRLWKKQNNPMFAEDKHGQKINLDTGEVLSDDAYKELVYQAPYQGFVNTISSKSFEDEILFSYQVDSKVNRKISDATIYATRQAQLGKDKKEETYVLGKIKDIYSQAGYDAFRKKYDKDKAVFLMYQKDPETWEKVIEVILRDYKELDDKGKEIGNPFERYKVKHGFVRKYSRKNKGTEIKSLKYYDNKLGNHIDITPNNSKHSVVLQSINPWRADLYFNPETTKYELMGLKYADLSFEKGTGKYSISREKYDEIKEREGISSKSEFKFTLYKNDLILVKDIGNHKELIARFNSKNDTSKHYVELKPWNKAKFDSEEELIPAFGKVAKSGQFIKGLNKPDLSIYKVKTDILGHKYYIKKEGDKPKLNFENKIKNK

SEQ ID NO: 546 - protein, 1125 aa, Streptococcus mutans; identical to SEQ ID NO: 545
  Streptococcus mutans U2A

SEQ ID NO: 547 - protein, 1345 aa, Streptococcus mutans
  Streptococcus mutans UA159
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 548 - protein, 1345 aa, Streptococcus mutans; identical to SEQ ID NO: 472
  Streptococcus mutans W6

SEQ ID NO: 549 - protein, 1121 aa, Streptococcus oralis
  Streptococcus oralis SK1074
MNGLVLGLDIGIASVGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKCRLINVFSTSAYRKEAEKILRKQQEFNNQITDEFIEDYLKILTGKRKYYHGPGNEKSRTDYGRFRTDGTTLDNIFGVLIGKCTFYPNEYRASKSSYTAQEFNLLNDLNNLTVPTETKKLSEEQKKVIVEYAKEAKTLGASTLLKYIVKMIDASVDQISGYRVDVNNKPEMHTFEVYRKMQSLETISVGELSRNVLDELAHILTLNTEREGIEEAINSKLMGVFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPGNIFNGHKELATKIRLWHQQGEKCLYTGKTIPISDLIHNQYKYEIDHILPLSLSFDDSLSNKVLVHATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFVDSQTGEIISLTDDEYKELVFKAPYDHFVDTLHSKTFEDGILFSYQVDSKYNRKISDATIYATRKAKLDKDKSEETYVLGKIKDIYSQAGYDAFIKIYNKDKRKFLMYHKDPQTFEKVIEEILRTYPSKERNDKNKEVPCNPFEKYRQENGPIRKYSKKGNGPEIKCLKYYDNKLGNYIDISPDGSDNQVVLQSLKPWRTDVYFNHQTKEYELMGLKYSDLSFEKGSGKYSISNEKYNSIKRIEGVNEQSEFKFTLYKNDLILIKDSENNEQKLFRFNSRNDTAKHYVELKPYDKARFDGQQELITILGNVAKGGQCLKGLNKSNISIFKVKTDVLGKKHIIKKEGDEPKLKF

SEQ ID NO: 550 - protein, 1373 aa, Streptococcus oralis
  Streptococcus oralis SK304
MENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASGLNAKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 551 - protein, 1134 aa, Streptococcus oralis
  Streptococcus oralis SK313
MNGLVLGLDIGIASVGVGILEKNSGKIVHASSRIFPAATADNNVERRKNRQARRLHRRKKHRGARLKDLFEYYGLLTDFSKVSINLNPYRLRVDGLDQQLTNEELFIALKNIVKRRGISYLDDASEDGGTVSSDYGKAVEENRKLLAEQTPGQIQLERFEKYGQLRGDFTVVENSEKCRLINVFSTSAYKKEAERILRKQQEFNNQITDEFIEDYLKILTGKRKYYHGPGNEKSRTDYGRFRTDGATLDNIFGILIGKCTFYPNEYRASKASYTAQEFNLLNDLNNLTVPTETKKLSEEQKKTIIEYAKSAKTLGASTLLKYIAKMIDASVDQIRGYRVDVNNKPEMHTFEVYRKMQSLETISVGELSRNILDELAHILTLNTEREGIEEAINTKLRDSFSQDQVLELVQFRKNNSSLFSKGWHNFSLKLMMELIPELYETSEEQMTILTRLGKQKSKETSKRTKYIDEKEVTEEIYNPVVAKSVRQAIKIINEATKKHGIFDNIVIEMARENNEEDAKKDYIKRQKANQDEKYAAMEKAAFQYNGKKELPDNIFHGHKELATKIRLWHQQGEKCLYTGKSIPISDLIHNQYKYEIDHILPLSLSFDDSLSNKVLVLATANQEKGQRTPFQALDSMDDAWSYREFKSYVKESKLLGNKKKEYLLTEEDISKIEVKQKFIERNLVDTRYSSRVVLNALQDFYKNHNFDTTISVVRGQFTSQLRRKWGLEKSRETYHHHAVDALIIAASSQLRLWKKQNNPLIAYKEGQFVDSQTGEIISLTDDEYKELVFKAPYDHFVDTLSSKTFEDSILFSYQVDSKFNRKISDATIYATRKAKLDKEKKEYTYTLGKIKDIYSLGTKTPSKTGFYKFLDLYNKDKSQFLMFQKDRKTWDEVIEKIMEQYRPFKEYDKAGKLVDFNPFEKYRQENGPIRKYSKKGNGPEIKSLKYYDILLGKHKNITPEGSRNTVALLSLNPWRTDVYYNMETKKYEFLGLKYADLPFEEGGAYGISTETYNELREKEGIGKNSEFKFTLYKNDLILIKDTETNCQQFFRFWSRTGKDNPKSFEKHKIELKPYEKAKFEKGEELEVLGKVPPSSNQFQKNMQIENLSIYKVKTDVLGNKHFIKKEGDKPKLKF

SEQ ID NO: 552 - protein, 1371 aa, Streptococcus oralis
  Streptococcus oralis SK610
MENKNYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLAEEKEYHKQFPTIYHLRKQLADSKEKTDLRLIYLALAHMIKYRGHFLYEDTFDIKNNDIQKIFSEFISIYDNTFEGSSLSGQNAQVEAIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLAVLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDSKNEEILENIVHTLTIFEDREMIKQRLAQYDSLFDEKVIKALIRRHYTGWGKLSAKLIDGICDKQTGNTILDYLIDDGKNNRNFMQLINDDGLSFKEITQKAQVVGKTDDVKQVVQELPGSPAIKKGILQSIKIVDELVKVMGHTPESIVIEMARENQTTARGKKNSQQRYKRIEDALKNLASGLDSNILKEHPTNNIQLQNDRLFLYYLQNGRDMYTGKPLDINQLSSYDIDHIVPQAFIKDDSLDNRVLTSLKDNRGKSDNVPSIEVVQKRKAFWQQLLDSKLISERKFNNLTKAERGGLDERDKVGFIKRQLVETRQITKHVAQILDARFNKEVNEKDKKNRTVKIITLKSNLVSNFRKEFRLYKVREINDYHHAHDAYLNAVVAKAILKKYPKLEPEFVYGDYQKYDLKRYISRSRNPKEVEKATEKYFFYSNLLNFFKEEVHYADGTIVKRENIEYSKDTGEIAWNKEKDFATIKKVLSYPQVNIVKKREVQTGGFSKESILPKGNSDKLIPRKTKDILWETTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPEHLEYIQKHRNEFKDLLNLVSEFSQKYVLADANLEKIQNLYADNEQADIEILANSFINLLTFTALGAPAAFKFFGKDIDRKRYTTVSEILNATLIHQSITGLYETRIDLSKLGED

SEQ ID NO: 553 - protein, 1140 aa, Streptococcus parasanguinis
  Streptococcus parasanguinis F0449
MNGLVLGLDIGIASVGVGILKKDIGEIIHTNSRLFSAATADSNIERRGHRGGKRLTRRKKHRSIRLHDLFEDFGLLTDFSKVSINLNPYQLRVQGLDNQLTNEELFIALKNIVKRRGISYLDDASEDGGTVSSDYGKAVEENRKLLAEQTPGQIQLDRFEKYGQVRGDFNVVENGEKRRLINVFTTSAYSKEAERILRKQQEFNKKITDEFIEDYLTILTGKRKYYHGPGNEKSRTDYGRYTTKKDPEGKYITLDNIFGILIGKCTFYPDEYRASKASYTAQEFNLLNDLNNLTVPTETKKLSEEQKKTIIKYAKTAKTLGASTLLKYIAKLIGASVDQIHGYRIDPNKKPEMHTFETYRKMQSLETISVEELPRKVLDELAHILTLNTEREGIEEAINATLKDTFSQDQVLELVQFRKNNSSLFSKGWHSFSLKLMMELIPELYETSEEQMTILTRLGKQKSKETSKRTKYIDEKELTEEIYNPVVAKSVRQAIKIINEATKKYGIFDNIVIEMARENNEEDAKKEYIKRQKANLDEKNAAMEKAAFQYNGKKELPDNVFHGHKELATKIRLWHQQGEKCLYTGKNIPISDLIQNQYKYEIDHILPLSLSFDDSLSNKVLVLATANQEKGQRTPFQALDSMDDAWSYREFKSYVKDSKLLGNKKKEYLLTEEDISKIEVKQKFIERNLVDTRYSSRVVLNALQDFYKEHQFDTTISVVRGQFTSQLRRKWGLEKSRETYHHHAVDALIIAASSQLRLWKKQNNPLISYTEGQFVDQVTGEIISLSDDEYKELVFKAPYDHFVDTLKSKKFEDSILFSYQVDSKYNRKISDATIYATRKAKLDKENKEYTYTLGKIKDIYALGTKSPSKTGFYKFLDLYNKDKSQFLMFQKDRKTWDEVIEKIIEQYRPFKEYDENGKEVDFNPFEKYRIENGPIRKYSKKGNGPEIKSLKYYDNLLGKFVDITPSESKNPVALLSLNPWRTDVYYNTETSKYEFLGLKYADLCFEKGGAYGISEVKYNKIREKEGIGKESEFKFTLYKNDLILIKDTETNCQQIFRFWSRTGKDNPKSFEKHKIELKPYEKARFEKGEELEVLGKVPPSSNQLQKNMQIENLSIYKVKTDVLGNKHFIKKEGEEPKLKF

SEQ ID NO: 554 - protein, 1130 aa, Streptococcus pasteurianus
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLKNEELFAALRTISKRRGISYLDDAEDDSTGSTDYAKSIDENRRLLKNKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVSTETGKLSTEQKESLVEFAKNTATLGPAKLLKEIAKILDCKVDEIKGYREDDKGKPDLHTFEPYRKLKFNLESINIDDLSREVIDKLADILTLNTEREGIEDAIKRNLPNQFTEEQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNSSDKLPDEVFHGNKQLETKIRLWYQQGERCLYSGKPISIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGKNQVVDKQTGEILSVSDDEYKELVFQPPYQGFVNTISSKGFEDEILFSYQVDSKYNRKVSDATIYSTRKAKIGKDKKEETYVLGKIKDIYSQNGFDTFIKKYNKDKTQFLMYQKDSLTWENVIEVILRDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKGLNKPNISIYKVRTDVLGNKYFVKKKGDKPKLDFKNNKK

SEQ ID NO: 555 - protein, 1374 aa, Streptococcus pseudoporcinus
  Streptococcus pseudoporcinus LQ 940-04
MKKRYSYSIGLDIGTNSVGWAVINEDYKVPAKKMTVFGNTDRKTIKKNLLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 556 - protein, 1368 aa, Streptococcus pyogenes
  Streptococcus pyogenes MGAS10270
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGLTIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 557 - protein, 1371 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGSD

SEQ ID NO: 558 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 559 - protein, 1368 aa, Streptococcus sp.
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 560 - protein, 1368 aa, Streptococcus pyogenes
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 561 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 562 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSNNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 563 - protein, 1368 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTVWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 564 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVETTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 565 - protein, 1368 aa, Streptococcus pyogenes [sequence omitted]

SEQ ID NO: 566 - protein, 1368 aa, Streptococcus pyogenes; identical to SEQ ID NO: 560

SEQ ID NO: 567 - protein, 1370 aa, Streptococcus ratti
  Streptococcus ratti FA-1 = DSM 20564
MKKPYSIGLDIGTNSVGWAVITDDYKVPAKKMKVLGNTDKNYIKKNLLGALLFDSGNTAEDRRLKRTARRRYTRRRNRLLYLQDIFSDEMNKVDESFFHRLEDSFLVSEDKRGDHHPIFGNVVDEVKYHEQFPTIYHLRKYLADTPEKADLRLVYLALAHMIKFRGHFLIDDPKLDVKNTDSQELFSQFLTAYDVTQEDSHLADVKINISDIITEKMNKSRKVEALLFHFPSQKKNSFFGNLVSLVFGLLPNFKTNFNLAEDAKLQLSKDSYDEDLENLLGQIGDEYTDVFVAARKLYDSILLSGILTVNDLSTKAILSASMVRRYEEHNKDLAKLKAFVKANFTHDVFKEVFSDASKNGYAGYIEGKTSQEDFYKYVKNLIGKVDGSADFIEKIDREDFLRKQRTFDNGSIPHQVHLAEMKAILRRQGEYYPFLKEHAEKIQQILTFRIPYYVGPLDRHGHSDFAWASFNSEEKVTPWNFEEIIDKNKSAQAFIERMTNQDLYLPNEKVLPKHSPLYEKYTVYNELTKIKYVTETGTAKFFDANLKQEIFDGLFKKERKVTKRKLLTFLEKNFDEFRIVDIQGLDKETETFNASYGIYQDLLKIIKDKAFMDDSENADILEDIVLTLTLFEDREMIKQRLAKYADLFDKKVIDNLARRRYTGWGRLSAKLLNGIRDKRSRKTIMDYLVDDGRSNRNLMQLITDDNLTFKDEIAKAQYSDNSDDLHQVVQDLAGSPAIKKGILQSVKIVDELVKVMGYEPEQIVVEMARENQTTAKGRRNSQQRYKRLEEAIKNLDRDLNYKILKEHPTDNQALQNDRLFLYYLQNGRDMYTGESLDINRLSDYDIDHIIPQAFIKDNSIDNRVLVSSAKNRGKSDDVPSEDVVNRMRPFWNKLLNCGLISQRKYSNLTKKELTPNDKAGFIKRQLVETRQITKHVARILDEHFNKEFDEDKKRIRKVKVVTLKSNLVSNFRKEFELYKVREINDYHHAHDAYLNAVVAKALLMKYPKLEPEFVYGEYPKYNSYRERKTATQRMFFYSNIMNMFKSKVKLADERIIERPMIEVNDETGEIAWDKTKHIATVKKVLSYPQINIVKKVEEQTGGLTNETIYPRGSFDKLLNRKNTLEASKYGGFGSPTVAYCVLVVADSKNENGKVKKLKLGSELLGITILEKNDFENNSLDFLSRKGYQGVQEKKIIKLPKYSLFEFQDGSRRMLSSVMANDNKRGDLQKANEMILPAYLVKLLYHAKHINSVGEPAHKNYINEHCSEFQDLLNYIRQFADKFVDVDKNLSKIRSLSKSMAEYSVSEICSSFVNLLTLTALGAPADFKFFGTTIPRKRYGSPQSILSATLIHQSITGLYETRIDLSKLGED

SEQ ID NO: 568 - protein, 1127 aa, Streptococcus salivarius
MSDLVLGLDIGIGSVGVGILNKVTGEIIHKNSRIFPAAQAENNVERRINRQGRRLTRRKKHRRVRLNHLFEESGLITDFTNVSINLNPYQLRVKGLTDELSNEELFIALKNMVKHRGISYLDDASDDGNSSVGDYAQIVKENSKQLETKTPGQIQLERYQKYGQLRGDFTVEEDGKKHRLINVFPTSAYRAEALRILQTQQEFNPQITDEFINSYLQILTGKRKYYHGPGNEKSRTDYGRYTTKKDSEDEYITLDNIFGILIGKCTFYPEEYRAAKASYTAQEFNLLNDLNNLTVPTETKKLSEEQKNQIITNVKNEKAMGPAKLFKYIAKLLSCDVADIKGYRIDKSDKAEIHTFEAYRKMKTLATIDIEQMERENLDKLAYVLTLNTEKEGIQEALEHEFADGTFSQEQIDELVQFRKANSSIFGKGWHSFSVKLMMELIPELYATSEEQMTILTRLGKQKTTSSSNKTKYIDEKQLTEEIYNPVAAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEIDHILPLSITFDDSLANKVLVYATANQEKGQRTPYQALDSMDDAWSFRELKAFVRDSKALSNKKKEYLLTEEDISKFDVRKKFIERNLVDTRYASRVVLNALQEHFRVHKTDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYSQTGYDAFIKIYKKDKSKFLMYRHDPQTFEKVIEPILENYPNKELNEKGKEVPCNPFLKYKEDHGYIRKYSKKGNGPEIKSLKYYDSKLGNHIDITPKNSNNKVVLQSVSPWRADVYFNKTTGKYEILGLKYADLKFEKGTGTYKISEEKYNDIKIKEGVDSDSEFKFTLYKNDLLLIKDTETKEQQLFRFLSRTMPNVKHYVELKPYDKQKFDDNEELIKILGIVAKGGQCKKGVSKPNISIYKIRTDVLGNQHIIKNEGDKPKLDF

SEQ ID NO: 569 - protein, 1385 aa, Streptococcus salivarius
  Streptococcus salivarius K12
MTKPYSIGLDIGTNSVGWAVITDDYKVPSKKMKVLGNTSKKYIKKNLLGALLFDSGITAEGRRLKRTARRRYTRRRNRILYLQEIFSTEMATLDDAFFQRLDDSFLVPDDKRDSKYPIFGNLVEEKVYHDEFPTIYHLRKHLADSSKKADLRLVYLALAHMIKYRGHFLIEGDFNSKNNDLQKNFQDFLDTYNAIFESDLSLENSKQLEEIVKDKISKSAKKDRILKLFPGEKNSGIFSEFLKLIVGNQADFRKYFNLDEKTSLQFSKESYDEDLETLLGHIGDDYSDVFLKAKKLYDAILLSGILTVTDNGTEAPLSSAMIMRYKEHEEDLALLKAYIRNISLETYNEVFKDNTKNGYAGYIDGKTSQEDFYVYLKRLLAGLEGADYFLEKIDREDFLRKQRTFDNGSIPYQIYLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYENFTVYNELTKVRFIAEGMRDYQFLDSKQKKDIVRLYFKGKRKVTDKDIIEYLHAIDGYDGIELKGIEKQFNSSLSTYHDLLNIINDKEFLDDSSNETIIEEIIHTLTMFEDREMIKQRLSKFDNIFDKSVLKKLSRRHYTGWGKLSAKLINGIRDEKSGNTILDYLIDDGVSNRNFMQLIHDDALSFKKKIKKAQIIGDKDNIKQVVKSLPGSPAIKKGILQSIKIVDELVKVMGREPESIVVEMARENQYTNQGKSNSQQRLKRLEESLKGLGSKILKENVPTRLSKIDNNALQNDRLYLYYLQNGKDMYTGEELDIDRLSNYDIDHIIPQAFLKDDSIDNKVLVSSASNRGKSDDVPSLEVVKKRKTLWYQLLKSKLISQRKFDNLTKAERGGLSQEEKAGFIQRQLVETRQITKHVARLLDERFNNKKDENNRTLRTVKIITLKSSLVSQFRKDFELYKVREINDFHHAHDAYLNAVVASALLKKYPKLEPEFVYGDYPKYNSFRERKSATEKVYFYSNIMNIFKKSIPLADGTVIDRPLIEVNEETGESVWNKVADLNTVRKVLSYSQVNIVKKVEEQNHGLDRGKPKGLFNANLSSKPKPNSKENLVGAKEYLDPKKYGGYAGISNSFAILVKGTIEKGAKKKITNVLEFQGISILDRIYYRKDKLNFLLEKGYKDIELIIELPKYSLFELSDGSRRMLASILSTNNKRGEIHKGNQIFISQKFVKLLYHAKRISSTFNENHRKYVENHKKEFEELFYYILEFNENYVGAKKNGELLKSAFQSWQNHSIDELCSSFIGPTGSERKGLFELTSRGGAADFEFLGVKIPRYRDYTPSSLLKDATLIHQSVTGLYETRIDLGKLGED

SEQ ID NO: 570 - protein, 1135 aa, Streptococcus salivarius
  Streptococcus salivarius PS4
MSDLVLGLDIGIGSVGVGILNKVTGEIIHKNSRIFPAAQAENNLERRTNRQGRRLTRRKKHRRVRLNHLFEESGLITDFTKVSINLNPYQLRVKGLTAELSNEELFIALKNMVKHRGISYLDDASDDGNSSVGDYAQIVKENSKQLETKTPGQIQLERYQKYGQLRGDFTVEEDGRKHRLINVFPTSAYHAEALRILQTQQEFNPQITDEFINSYLEILTGKRKYYHGPGNEKSRTDYGKYTTKKDAQGQYITLNNIFGILIGKCTFYPEEYRAAKASYTAQEFNLLNDLNNLTVPTETKKLSEEQKYQIITYVKNEKAMGPAKLFKYIAKLLACDIADIKGYRIDKSDKAEIHTFEAYRKMKTLETIDIEQIEREKLDKLAYVLTLNTEREGIQEALDHEFADGTFSQEQVDELVQFRKANSSIFGKGWHSFSVKLMMELIPELYATSEEQMTILTRLGKQKTTSSSNKTKYIDEKQLTEEIYNPVVAKSVRQAIKIVNAAIKKYGDFDNIVIEMARETNEDDEKKAIQKIQKANKAEKDAAMRKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKALSNKKKEYLLTEEDISKFDVRKKFIERNLVDTRYASRVVLNALQEHFKAHKIDTKVSVVRGQFTSQLRRHWGIDKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYALGTKTPSKTGFYKFLDLYNKDKSQFLVYQKDRKTWDEVIEKIMEQYRPFKESDKNGKEVDFNPFEKYRIENGPIRKYSRKGNGPEIKSLKYYASKLGNHIDITPKDSNNKVVLQSVSPWRADVYFNKTTGSYEILGLKYADLQFEKGTGTYRISEEKYNDIKKKEGVDSDSEFKFTLYKNDLLLIKDTETKEQRLFRFLSRSMPNKKHYVELKPYSKDKFEKNESLIEILGSADKSGRCIKGLAKSNLSIFKVRTDVLGNQHIIKNEGDKPKLDF

SEQ ID NO: 571 - protein, 1377 aa, Streptococcus sanguinis
  Streptococcus sanguinis SK115
MKKPYSIGLDIGTNSVGWAVITDDYKVPSKKMKVLGNTDKHFIKKNLIGALLFDEGTTAEDRRLKRTSRRRYTRRKNRLRYLQEIFSEEISKLDSSFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSTKRERVLKLFSDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQEDLAALKQFIKNNLSEKYAEVFSDQSKDGYAGFIDGKTTQEAFYKYIKNLLSKLEGADYFLNKIEREDFLRKQRTFDNGSIPHQIHLQEMNAILRRQGEHYLFLKENREKIEKILAFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDNPKNGEILENIIHTLTIFEDREMIKQRLAQYDTLFDEKVIKALTRRHYTGWGKLSAKLINGIRDKQTGKTILEYLIDDGDCNRNFMQLINDDGLSFKEIIQKAQVVGKTDDVKQVVQEIPGSPAIKKGILQSIKIVDELVKVMGHNPESIVIEMARENQTTAKGKKNSQQRYKRIEDALKNLAPGLDSNILKENPTDNIQLQNDRLFLYYLQNGKDMYTGKAIDINQLSNYDIDHIIPQAFIKDDSLDNRVLTSSKDNRGKSDNVPSIEVVQKRKAFWQQLLDSKLISERKFNNLTKAKRGGLDERDKVGFIKRQLVETRQITKHVAQLLDTRFNTEVNEENQKIRTVKIITLKSNLVSNFRKEFGLYKVREINDYHHAHDAYLNAVVAKAILKKYPKLEPEFVYGDYQKYDLKRYILKSKASNTIDKATEKYFFYSNLLNFFKEKVRYADGTIKKRENIEYSNDTGEIAWNKEKDFATIKKVLSLPQVNIVKKTEEQTVGQNGGLFDNNIVSKKKVVDASKLIPIKSSLSPEKYGGYARPTIAYSVLVIADIEKGKGKAKKLKRIKEIVGITIQDKKKFESNPVTYLEECGYKNINSNLIIKLPKYSLFEFNDGQRRLLASSIELQKGNELILPYHLTALLYHAQRINKISEPIHKQYVEAHQNEFKELLTTIISLSKKYIQKPNVELLLQQAFDQADKDIYQLSESFISLLKLTSFGAPGAFKFLGVEISQSSVRYKPNSQFLDTTLIHQSITGLYETRIDLSKLGED

SEQ ID NO: 572 - protein, 1392 aa, Streptococcus sanguinis
  Streptococcus sanguinis SK330
MENKNYSIGLDIGTNSVGWAVITDDYKVPSKKMKVFGNTDKHFIKKNLIGALLFDEGATAEDRRLKRTARRRYTRRKNRLRYLQEIFSEEISKLDSSFFHRLDDSFLVPKDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSAKRERVLKLFSDEKSTSLFSEFLKLIVGNQADFKKHFDLEEKAPLQFSKDTYDEDLENLLGQIGDGFTDLFLVAKKLYDAILLSGILTVTDPSTKAPLSASMIERYESHQKDLAALKQFIKNNLPKRYNEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEEFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSIFDEKVIKALTRRHYTGWGKLSAKLINGICDKQTGDTILDYLIDDGKINRNFMQLINDDGLSFKEIIQKAQVVGKTDDVKQVVQELPGSPAIKKGILQSIKIVDELVKVMGYAPESIVIEMARENQTTARGKKNSQQRYKRIEDSLKNLAPGLDSNILKENPTDNIQLQNDRLFLYYLQNGKDMYTGKPLDIDQLSSYDIDHIIPQAFIKDDSIDNRVLTSSKDNRGKSDNVPSLEVVQKRKAFWQQLLDSKLISERKFNNLTKAERGGLDERDKVGFIRRQLVETRQITKHVAQILDASFNTEVNEKNQKIRTVKIITLKSNLVSNFRKEFELYKVREINDYHHAHDAYLNAVVAKAILKKYPKLEPEFVYGDYQKYDLKRYISRFKPSKEIEKATEKYFFYSNLLNFFKEEVHYADGIIVKRENIEYSKDTGEIAWNKEKDFATIKKVLSYPQVNIVKKTEIQTHGLDRGKPKGLFNSNPSPKPSEDSKENLVPIKQGLDPRKYGGYAGISNSYAVLVKAIVEKGAKKQQKTILEFQGISILDKINFENNKENYLLKKRYIEILSTITLPKYSLFEFPDGTRRRLASILSTNNKRGEIHKGNELVLPGKYTTLLYHAKNINKKLEPEHLEYVEKHRNDFAKLLECVLNFNDKYVGALKNGERIRQAFTDWETVDIEKLCFSFIGPENSKNAGLFELTSQGSASDFEFLGVKIPRYRDYAPSSLLKATLIHQSITGLYETRIDLSKLGED

SEQ ID NO: 573 - protein, 1370 aa, Streptococcus sanguinis
  Streptococcus sanguinis SK353
MKKPYSIGLDIGTNSVGWAVVTDDYKVPAKKMRVFGDTDRSHIKKNLLGTLLFDDGNTAESRRLKRTARRRYTRRRNRILYLQEIFTESMNEIDESFFHRLDDSFLVPEDKRGSKYPIFATLQEEKEYHKQFPTIYHLRKQLADSKEKSDVRLIYLALAHMIKYRGHFLYEETFDIKNNDIQKIFNEFINIYDNTFEGSSLSGQNAQVEAIFTDKISKSAKRERVLKLFPDEKSTGLFSEFLKLIVGNQADFKKHFDLEEKAPLQFSKDTYDEELENLLGQIGDDFADLFLIAKKLYDAILLSGILTVTDPSTKAPLSASMIERYENHQKDLAALKQFIKNNLPEKYVEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARDNRDFSWLTRNSDEPIRPWNFEEVVDKARSAEDFIHRMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNANLSTYHDLLKITKDKEFMDDPKNEEILENIVHTLTIFEDREMIKQRLAQYDTLFDEKVIKALTRRHYTGWGKLSAKLINGIRDKQSGKTILDYLIDDDKINRNFMQLINDDGLSFKEIIQKAQVVGKTDDVKQVVQELPGSPAIKKGILQSIKIVDELVKVMGYALESIVIEMARENQTTARGKKNSQQRYKRIEDALKNLAPGLDSNILKENPTDNIQLKNDRLFLYYLQNGKDMYTGKPLDINQLSSYDIDHIIPQAFIKDDSIDNRVLTSSKDNRGKSDNVPSLEVVQKRKAFWQQLLDSKLISERKFNNLTKAERGGLDERDKVGFIRRQLVETQQITKNVAQILDARFNTEVKEKNQKIRTVKIITLKSNLVSNFRKEFGLYKVREINNYHHAHDAYLNAVVAKAILKKYPKLEPEFVYGDYQKYDLKKYISRFKPSKEIEKATEKYFFYSNLLNFFKEEVLYADGTIRKRENIEYSKDTGEIAWDKEKDFATIKKVLSYPQVNIVKKREVQTGGFSKESILPKGNSDKLIPRKTKDILWDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVCLTTLLYHSKNLHKLDEPEHLEYIQKHRNEFKDLLNLVSEFSQKYILAEANLEKIKDLYADNEQADIEILANSFINLLTFTALGAPAAFKFFGKDVDRKRYTTVSEILNATLIHQSITGLYETRIDLSKLGEE

SEQ ID NO: 574 - protein, 1421 aa, Streptococcus sanguinis
  Streptococcus sanguinis SK49
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 575 - protein, 1026 aa, Streptococcus sp.
  Streptococcus sp. BS35b
MNGLVLGLDIGIASVGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKRRLINVFSTSAYRKEAEKILRKQQEFNNQITDEFIEDYLKILTGKRKYYHGPGNEKSRTDYGRFRTDGTTLDNIFGVLIGKCTFYPNEYRASKSSYTAQEFNLLNDLNNLTVPTETKKLSEEQKKVIVEYAKEAKTLGASTLLKYIVKMIDASVDQISGYRVDVNNKPEMHTFEVYRKMQSLETISVGELSRNVLDELAHILTLNTEREGIEEAINSKLMGVFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPGNIFNGHKELATKIRLWHQQGEKCLYTGKTIPISDLIHNQYKYEIDHILPLSLSFDDSLSNKVLVHATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFIDSQTGEIISLTDDEYKELVFKAPYDHFVDTLHSKTFEDGILFSYQVDSKYNRKISDATIYATRKAKLDKDKSEETYVLGKIKDIYSQAGYDAFIKIYNKDKRKFLMYHKDPQTFEKVIEEILRTYPSKERNDKNKEVPCNPFEKYRQENGPIRKYSKKGNGPEIKCLKYYDNKLGNYIDISPDGSDNQVVLQSLKPWRTDVYFNHQTKKYELMGLKYSDLSFEKGSGKYSISNEKYNSIKRIEGVNEQSEFKFTLYK

SEQ ID NO: 576 - protein, 1139 aa, Streptococcus sp.
  Streptococcus sp. C150
MSDLVLGLDIGIGSVGVGILNKVTGEIIHKNSRIFPAAQAENNLERRTNRQGRRLTRRKKHRRVRLNHLFEESGLITDFTKVSINLNPYQLRVKGLTAELSNEELFIALKNMVKHRGISYLDDASDDGNSSVGDYAQIVKENSKQLETKTPGQIQLERYQKYGQLRGDFTVEEDGRKHRLINVFPTSAYHAEALRILQTQQEFNPQITDEFINSYLEILTGKRKYYHGPGNEKSRTDYGKYTTKKDAQGQYITLNNIFGILIGKCTFYPEEYRAAKASYTAQEFNLLNDLNNLTVPTETKKLSEEQKYQIITYVKNEKAMGPAKLFKYIAKLLSCDVADIKGYRIDKSDKAEIHTFEAYRKMKTLETLDVKKMAREELDKLAYVLTLNTEREGIQEALDHEFADGTFSQEQVDELVQFRKANSSIFGKGWHSFSVKLMMELIPELYATSEEQMTILTRLGKQKTTSSSNKTKYIDEKQLTEEIYNPVVAKSVRQAIKIVNAAIKKYGDFDNIVIEMARETNEDDEKKAIQKIQKANKAEKDAAMRKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKALSNKKKEYLLTEEDISKFDVRKKFIERNLVDTRYASRVVLNALQEHFRTHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRKAKLDKEKKEYTYTLGKIKDIYALGTKTPSKTGFYKFLDLYKKDKSQFLMYQKDRRTWDEVIEKILEQYRPFKEKDKNGKEVDFNPFEKYRIENGPIRKYSRKGNGPEIKSLKYYDNLLGRFVDITPSESKNPVALLSLNPWRTDVYYNTETRKYEFLGLKYADLCFEKGGSYGISKVKYNKIREKEGIGKNSEFKFTLYKNDLILIKDTETNRQQIFRFWSRTGKDNPKSFEKHKLELKPYEKTRFEKGEELKVLGKVPPSSNRLQKNMQIENLSIYKVRTDVLGNQHIIKNEGDKPKLDF

SEQ ID NO: 577 - protein, 1377 aa, Streptococcus sp.
  Streptococcus sp. C300
MNNKPYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLEEKAPLQFSKDTYDEDLENLLEQIGDDFADLFVAAKKLYDAILLSGILTVTDPSTKAPLSASMIERYENHQKDLAVLKQFIKTNLPEKYVEVFSDQSKDGYAGYIDGKTTQEAFYKYIKNLLSKFDGADYFLDKIEREVFLRKQRTFDNGSIPHQIHLQEMNTILRRQGEHYPFLKENKEKIEKILTFRIPYHVGPLARGNRDFAWLTRNSDQAIRPWNFEEIVDKASSAEDFINKMTNYDLYLPEEKVLPKHSLLYETFAVYNELTKVKFIAEGMRDYQFLDSGQKKKIINQLFKKKRKVTEDDIIDCLQKIDNYDGIELKGIEKQFNASLSTYHDILKIIRDKEFMDDPKNGDILENVIHTLTIFEDREMIKQRLAQYNSIFDEKVIKALSRKHYTGWGKLSAKLIDGIRDKQTGKTILDYLMDDGKSNRNFMQLIKDDELSFTEIIQKAQVVGDTDNLRQVVQNLPGSPAIKKGILQSIKIVDELVKVMGHAPESIVIEMARENQTTARGKKNSQQRYKRIEDSLKNLASGLDSNILKENPTDNIQLQNDRLFLYYLQNGKDMYTGEALNINQLSSYDIDHIIPQAFIKDDSLDNRVLTSSKDNRGKSDNVPSLEVVEKMKAFWQQLLDSKLISERKYNNLTKAERERGGLNELDKVGFIKRQLVETRQITKHVAQILDARFNKEVTEKNKKNRNVKIITLKSNMVSNFRKEFGLYKVREINDYHHAHDAYLNAVVAKAILKKYPKLEPEFVYGDYQKYDLKRYISRSKDPKEVEKATEKYFFYSNLLNFFKEEVHYADGTIVKRENIEYSKDTGEIAWNKEKDFATIKKVLSLPQVNIVKKTEEQTVGQNGGLFDNNIVSKKKVVDASKLIPIKSGLSPEKYGGYARPTIAYSVLVTYKQNNKIKNTMVGIPVLTKLEFERDPNLYLRNLGINNVSHVIKLVKYTVLEFKHKYGTYRRFIVSNQELKRANQIFVTTKQMKLISQYTTLDKNEHDSLLKNNQQLIQSIWNQFLEFMLATDLVNKKQYDELILTNNQTIEECRNIMNRVITTLSFTNINAGQKKIIFDDTLSLPIKRWQFTDSDKMVKKIIESTLIHQSITGLYETRIDLSKLGED

SEQ ID NO: 578 - protein, 1371 aa, Streptococcus sp.
  Streptococcus sp. F0441
MENKNYSIGLDIGTNSVGWSVITDDYKVPSKKMKVLGNTDKHFIKKNLIGALLFDEGTTAEARRLKRTARRRYTRRKNRLRYLQEIFSEEIGKVDSSFFHRLDDSFLIPEDKRGSKYPIFATLAEEKKYHKQFPTIYHLRKQLADSKEKTDLRLIYLALAHMIKYRGHFLYEEAFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFLVAKKLYDAILLSGILTVTNPSTKAPLSASMIERYENHQKDLASLKQFIKNNLPEKYDEVFSDQSEDGYAGYIDGKTTQETFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKAFMDDAKNEAILENIVHTLTIFEDREMIKQRLAQYDSLFDEKVIKALTRRHYTGWGKLSAKLINGISDKQTGNTILDYLIDDGEINRNFMQLINDDGLSFKEIIQKAQVVGKTNDVKQVVQELPGSPAIKKGILQSIKIVDELVKVMGHAPESIVIEMARENQTTARGKKNSQQRYKRIEDSLKILASGLNSKILKEHPTDNIQLQNDRLFLYYLQNGKDMYTGEALDINQLSSCDIDHIIPQAFIKDDSLDNRVLTSSKDNRGKSDNVPSLEVVDKMKVFWQQLLDSKLISYRKFNNLTKAERGGLNELDKVGFIKRQLVETRQITKHVAQILDARFNKEVTEKDKKNRTVKIITLKSNLVSNFRKEFELYKVREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKKLKTVKTLVGITIMEKDAFEKNPIAFLENKGYHNVCKENILCLPKYSLFELENGRRRLLASAKELQKCNEIVLPVYLTTLLYHSKNVHKLDEPGHLEYIQKHRNEFKDLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 579 - protein, 1121 aa, Streptococcus sp.
  Streptococcus sp. GMD6S
MNGLVLGLDIGIASVGVGILEKNSGKIIHANSRLFPAATADNNVERRKNRQARRLHRRKKHRGVRFQDLFEDYGLLTDFSKVSINLNPYRLRVDGLNQQLTNEELFIALKNIVKRRGISYLDDASEDGGTVSSDYGKAVEENRKLLAEQTPGQIQLERFEKYGQVRGDFTVVENGEKRRLINVFSTSAYRKEAERILRKQQEFNSKITDEFIEDCLKILTGKRKYYHGPGNEKSRTDYGRFRTDGTTLDNIFGILIGKCTFYPDEYRASKASYTAQEFNLLNDLNNLTVPTETKKLSEEQKKVIVEYAKEAKTLGASTLLKYIAKMIDASVDQIRGYRVDVNNKPEIHTFEAYRKMQSLETISVGELSRNVLDELAHILTLNTEREGIEEAINTKLKDSFSQDQVLELVQFRKNNSSLFSKGWHNFSLKLMMELIPELYETSEEQMTILTRLGKQKSKEISKRTKYIDEKELTEEIYNPVVAKSVRQAIKIINEATKKHGIFDNIVIEMARENNEEDAKKDYIKRQKANQDEKNAAMEKAAFQYNGKKELPDSIFHGQKELATKIRLWHQQGEKCLYTGKNIPISDLIHNQYKYEIDHILPLSLSFDDSLSNKVLVLATANQEKGQRTPFQALDSMDDAWSYREFKSYVKESKLLGNKKKEYLLTEEDISKIEVKQKFIERNLIDTRYSSRVVLNALQDFYKAHKFDTTISVVRGQFTSQLRRKWGLEKSRETYHHHAVDALIIAASSQLRLWKKQNNPLIAYKEGQFVDSETGEIISLSDDEYKELVFKAPYDHFVDTLSSKTFEDSILFSYQVDSKFNRKISDATIYATRKAKLDKEKSEETYVLGKIKDIYSQAGYDAFIKIYNKDKSKFLMYHKDPQTFEKVIEEILRTYPSKELNDKNKEIPCNPFEKYRQENGPIRKYSKKSNGPEIKSLKYYDNKLGNHIDITPESSDNQVVLQSLKPWRTDVYFNHQTKKYELMGLKYSDLSFEKGSGKYSISNQKYNSIKRIEGIDEQSEFKFTLYKNDLILIKDSENNEQKLFRFNSRNDTAKHYIELKPYDKAKFDGEQELITILGNVAKGGRCLKGLNKSNISIFKVKTDVLGKKHIIKKEGDEPKLKF

SEQ ID NO: 580 - protein, 1375 aa, Streptococcus sp.
  Streptococcus sp. M334
MSNKSYSIGLDIGTNSVGWAVITDDYKVPSKKMKVLGNTDKHFIKKNLIGALLFDEGTTAEDRRLKRTARRRYTRRKNRLRYLQEIFSQEISKVDSSFFHRLDDFFLVPEDKRGSKYPIFATLVEEKEYHKKFPTIYHLRKHLADSKEKTDLRLIYLALAHMIKYRGHFLYEESFDIKNNDIQKIFSEFISIYDNTFEGKSLSGQNAQVEAIFTDKISKSTKRERVLKLFPDEKSTGLFSEFLKLIVGNQADFKKHFDLEEKAPLQFSKDTYDEDLENLLGQIGDDFADLFLVAKKLYDAILLSGILTVKDLSTKAPLSASMIERYENHQKDLAALKQFIQNNLQEKYDEVFSDQSKDGYAGYIDGKTTQEAFYKYIKNLLSKFEGADYFLDKIEREDFLKKQRTFDNGSIPHQIHLQEMNAIIRRQGEHYPFLQENKEKIEKILTFRIPYYVGPLARGNGDFAWLTRNSDQAIRPWNFEEIVDQASSAEDFINKMTNYDLYLPEEKVLPKHSLLYETFAVYNELTKVKFIAEGLTRYQFLDKKQKKDIFDTFFKAENKRKVTEKDIIHYLHNVDGYDGIELKGIEKQFNASLSTYHDLLKIIKDKAFMDDSKNEEILENIIHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTNDVKQVVQELPGSPAIKKGILQSIKIVDELVKVMGHAPESIVIEMARENQTTARGKKNSQQRYKRIEDSLKNLASGLDSNILKENPTDNIQLQNDRLFLYYLQNGRDMYTGKPLEINQLSNYDIDHIIPQAFIKDDSLDNRVLTSSKDNRGKSDNVPSLEVVEKMKAFWQQLLDSKLISERKFNNLTKAERERGGLNELDKVGFIKRQLVETRQITKHVAQFLDARFNKEVTEKDKKNRNVKIITLKSNLVSNFRKEFGLYKVREINDYHHAHDAYLNAVLAKAILKKYPKLEPEFVYGDYQKYDLQRYISKSREPKEVEKATQKYFFYSNLLNFFKEEVHYADGTIVKRENIEYSKDTGEIAWNKEKDFATVKKVLSLPQVNIVKKTEVQTGGFSKESILPKGNSDKLIPRKTKEILWDTTKYGGFDSPVIAYSILLIADIEKGKAKKLKTVKTLVGITIMEKATFEKNPITFLENKGYHNVRKENILCLPKYSLFELESGRRRMLASAKELQKGNEIVLPVYLTTLLYHSKNVHKLDEPEHLEYIQKHRYEFKDLLNLVSEFSQKYVLADANLEKIKNLYADNEQADIEILANSFINLLTFTALGAPAAFKFLGKDVDRKRYTTVSEILNATLIHQSITGLYETRIDLSKLGED

SEQ ID NO: 581 - protein, 1371 aa, Streptococcus sp.
  Streptococcus sp. oral taxon 056 str. F0418
MNNNNYSIGLDIGTNSVGWAVITDDYKVPSKKMRVLGNTDKRFIKKNLIGALLFDEGTTAEDRRLKRTARRRYTRRKNRLRYLQEIFAEEMSKVDSSFFHRLDDSFLVPEDKSGSKYPIFATLAEEKEYHKKFPTIYHLRKHLADSKEKADLRLIYLALAHITKYRGHFLYEEAFDIKNNDIQKIFNEFINIYDNTFEGSSLSGQNAQVEAIFTGKISKSVKREHVLKLFPDEKSTGLFSEFLKLIVGNQADFKKHFDLEEKASLQFSKDTYDEDLENLLGQIGDDFADLFLVAKKLYDAILLSGILTVTDPSTKAPLSASMIERYENHQEDLAALKQFIKNNLPEKYAEVFSDQSKDGYAGYIDGKTTQEAFYKYIKNLLSKFEGADYFLDKIEREDFLRKQRTFDNGSIPHQIHLQEMNAILRRQGEHYPLLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFFDSGQKKQIVNQLFKEKRKVTEKDIIHYLHNVDGYDGIELKGIEKQFNASLSTYHDLLKIIKDKEFMDNHKNQEILENIVHTLTIFEDREMIKQRLAQYDSIFDEKVIKALTRRHYTGWGKLSAKLINGICDKKTGKTILDYLIDDGYNNRNFMQLINDDGLSFKEIIQKAQVVGKTDDLTQVVRELSGSPAIKKGILQSIKIVDELVKIMGYAPESIVIEMARENQTTAKGKKNSQQRYKRIEDALKNLAPGLDSTISKENPTDNIQLQNDRLFLYYLQNGKDMYTGEALDINQLSSYDIDHIIPQAFIKDDSLDNRVLTSSKDNRGKSDNVPSLEVVKKRKAFWQQLLDSKLISERKFNNLTKAERGGLDERDKVGFIKRQLVETRQITKHVARILDARFNTEVSEKNQKIRSVKIITLKSNLVSNFRKEFKLYKVREINDYHHAHDAYLNAVVAKAILKKYPKLEPEFVYGDYQKYDLKRYISKSKDPKEVEKATEKYFFYSNLLNFFKEEVHYADGTIVKRENIEYSKDTGEIAWNKEKDFVTIKKVLSYPQVNIVKKREVQTGGFSKESILPKGNSDKLIPRKTKDILWDTTKYGGFDSPVIAYSILLIADIEKGKAKKLKTVKTLVGITIMEKAAFEKNPITFLENKGYHNVRKENILCLPKYSLFELENGRRRLLASAKELQKGNEIVLPVYLTTLLYHSKNVHKLDEPEHLEYIQKHRYEFKDLLNLVSEFSQKYVLAEANLEKIKSLYVDNEQADIEILANSFINLLTFTALGAPAAFKFFGKDVDRKRYTTVSEILNATLIHQSITGLYETRIDLSKLGED

SEQ ID NO: 582 - protein, 1420 aa, Streptococcus sp.
  Streptococcus sp. oral taxon 071 str. 73H25AP
MAKFNKNYSIGLDIGVSSVGYAVVTEDYRVPAFKFKVLGNTEKEKIKKNLIGSTTFVPAQSAQGTRVFRVNRRRIDRRNHRIAYLRDIFQKEIEKIDKNFYRRLDESFRVLGDKSEDIQIKQPFFGNKELETAYHKKYPTIYHLRKHLADADKNSPVADIREVYMVLSHILKYRGHFLTLGKIDPNNINMQNSWIDFIESCQDAFDLEISDESKTIAAIFKSSENRQEKVKQILSYFQQELLKKDKSIFKQLLQLLFGLKTKFKDCFELEEEPDLNFSKENYDENLENLLGALEEDFSDVFAKLKILRDTILLSSMLTYTGATHARFSATMVERYEEHRKDLQRFKSFVKQNLSEQDYLDIFGRKTPTGFDVDKETKGYVGYISNKMVLTNPQKQKTIQQNFYDYISGKITGIEGAECFLNKISDGTFLRKLRTTDNGAIPNQIHAYELEKIIERQGRDYPFLLENKDKLLSILTFKIPYYVGPLAKGNNSRFAWIKRTTSQDVLDDNDEDTRNGKIRPWNYHKLINMDETRDAFIINLIGNDIILLNEKVLPKRSLIYEEVMLQNELTRVKYKDKYGKIHFFNSELRQEIINNLFKTNSKRVSSAMLLSYLENFTNLQAVEIVSGIEKGKSLNSTLKTYNDLKTIFSEELLDSEIYQKELEEIIKVITVFDDKKSIKNYLTKYFGHLEFLNEEKINQLSKLRYTGWGRYSGKLLLGIRDEDTGFNLMQFLRNDDENRNLTQLISDTTLSFDSAIKAIQSKSTVEDDVFEEIKNLAGSPAIKRGILNSIKIVDELVQIIGYPPQNIIIEMARENMTTEEGQKKAKTRKSKLESALKNIEDSVLESGKVPHSDEQLQSEKLYLYYLQNGKDMYSLDKTGSPTPLYRDQLDQYEVDHIIPYSFLPIDSIDNKVLTHRENNQRKLNNIPDKETVANMKPFWEKLYNAKLISQTKYQRLTTSERTPDGVLTESMKAGFIERQLVETRQIIKHVARILDNRFSDTKIITLKSQLVTNFRNTFHIAKIRELNDYHHAHDAYLAVVVGQTLLKAYPKLAPELIYGHHAHFNRHEENKATLRKHLYSNIMRFFNNPDSKVSKDIWDCNRDLPIVKDVIYNSQINFVKRTMIKKGAFYNQNPVGKLNKQIAANNRYPLKTKVSSLDTSIYGGYGPMNSALSIIIIAERFNEKKGKIETVKEFHDIFIIDYEKFNNNPFQFLNNVSEEGFLKKNDLNRVLAFYRISKYSLMQKIDGTRMLFESKSNLHKVTQFKLTKTQNELFFHMKRLLTKSNLMDLKSESAIKESQNFIQTHQNEFDNIADRLSNYSQKMLGETKSLQTLINGYNERPIKQIDNNEETIRYYYDNFIKMFSFVKSGAPKDIINFFNDKYTVPRMRPKPDRKMLDATLIHQSITGLYETRIDLSKLGED

SEQ ID NO: 583 - protein, 1122 aa, Streptococcus suis
  Streptococcus suis 89/1591
MSNGKILGLDIGIASVGVGVIDAQTGEIIHASSRIFPSANAANNAERRTFRGSRRLIRRKKHRIKRLDDLFNDFHINLDGEMSTDNPYVLRVKGLSQKLTVEELYISIKNIMKRRGISYLDDAESDNEAGRSDYAKAIERNRQLLTSKTPGEIQLERLEKYGQLRGNFTIIDEEGQSQQIINVFSTSDYVKEVEKILDCQKMYHKFISDEFCDKLIELLREKRKYYVGPGNEKSRTDYGIYRTDGTTLENLFGILIGKCTFYPDQYRSSRASYTAQEFNFLNDLNNLTVPTETKKLSQEQKEFLVNYAKETSVLGAGKILQQIAKLADCKVEDIRGYRLDNKDKPELHTFETYRAMKGLVPLVDIGVLSREQLDILADILTLNTDFEGIREALKKQLPNVFDEKQVKGLASFRKSKSQLFAKGWHNLSQKIMLEVIPELYATSDEQMTILTRLGKFEKSSVAEYPSSINVDEITDEIYNPVVAKSIRQTIKIINASIKKWGEFDQIVIEMPRDRNEDEEKKRIADGQKANAKEKADSILRAAELYCAGKVLPDYVYNGHNQLATKIRLWYQQGERCIYTGQPISIHDLIHNQNQYEIDHILPLSLTFDDSLSNKVLVLATANQEKAQRTPYNYLKSATSAWSYREFKDYVTKRKGIGKKKCEYLTFEEDINGFEVRSKFIQRNLVDTRYASKVILNALQDYFKISGIQTKVSVVRGQFTSQLRHKWGIEKTRETYHHHAVDALIIAASSQLRLWKKQESPLVVDYQEGRQVDLETGEILELTDEQYKELVYQPPYQGFVNTISSSAFDNEILFSYQVDSKVNRKISDATIYATRNAQLGKDKTEGIYVLGKIKDIYTQAGYEAFLKRYTKDKTSFLMYHKDLDTWEKVIEIILRDYREYDEKGKEIGNPFERYRRENGYVKKYSRKGNGTAIKSLKYYDNKLGNHIDITPENSRNAVVLQSLKPWRTDVYFNKETGKYEFLGIKYSDLSFEKGTGEYGISQEKYDSIKIAEGVAKKSIFKFTLYKQDLLFIKDIENNFGKLLRFTSKNDTSKHYVELKPYDKNKFGTEEPLLPVLGNVAKSGQCIKGLNKSNISIYKVRTDILGYRHFIKQEGEHPQLKFKK

SEQ ID NO: 584 - protein, 1122 aa, Streptococcus suis
MSNGKILGLDIGIASVGVGVIDAQTGEIIHASSRIFPSANAANNAERRTFRGSRRLIRRKKHRIKRLDDLFNDFHINLDGEMSTDNPYVLRVKGLSQKLTVEELYISIKNIMKRRGISYLDDAESDNEAGRSDYAKAIERNRQLLTSKTPGEIQLERLEKYGQLRGNFTIIDEEGQSQQIINVFSTSDYVKEVEKILDCQKMYHKFISDEFCDKLIELLREKRKYYVGPGNEKSRTDYGIYRTDGTTLENLFGILIGKCTFYPDQYRSSRASYTAQEFNFLNDLNNLTVPTETKKLSQEQKEFLVNYAKETSVLGAGKILQQIAKLADCKVEDIRGYRLDNKDKPELHTFETYRAMKGLVPLVDIGVLSREQLDILADILTLNTDFEGIREALKKQLPNVFDEKQVKGLASFRKSKSQLFAKGWHNLSQKIMLEVIPELYATSDEQMTILTRLGKFEKSSVAEYPSSINVDEITDEIYNPVVAKSIRQTIKIINASIKKWDEFDQIVIEMPRDRNEDEEKKRIADGQKANAKEKADSILRAAELYCAGKVLPDYVYNGHNQLATKIRLWYQQGERCIYTGQPISIHDLIHNQNQYEIDHILPLSLTFDDSLSNKVLVLATANQEKAQRTPYNYLKSATSAWSYREFKDYVTKRKGIGKKKCEYLTFEEDINGFEVRSKFIQRNLVDTRYASKVILNALQDYFKISGIQTKVSVVRGQFTSQLRHKWGIEKTRETYHHHAVDALIIAASSQLRLWKKQESPLVVDYQEGRQVDLETGEILELTDEQYKELVYQPPYQGFVNTISSSAFDNEILFSYQVDSKVNRKISDATIYATRNAQLGKDKTEGIYVLGKIKDIYTQAGYEAFLKRYTKDKTSFLMYHKDLDTWEKVIEIILRDYREYDEKGKEIGNPFERYRRENGYVKKYSRKGNGTAIKSLKYYDNKLGNHIDITPENSRNAVVLQSLKPWRTDVYFNKETGKYEFLGIKYSDLSFEKGTGEYGISQEKYDSIKIAEGVAKKSIFKFTLYKQDLLFIKDIENNFGKLLRFTSKNDTSKHYVELKPYDKNKFGTEEPLLPVLGNVAKSGQCIKGLNKSNISIYKVRTDILGYRHFIKQEGEHPQLKFKK

SEQ ID NO: 585 - protein, 1381 aa, Streptococcus suis
MVKKKYAIGIDIGTNSVGWSIVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDRYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYEPEHIVVEMARENQFTNQGRRNSQQRINRLENALKDFGSKILEEQKPYGVSKVNNIHLQSDRLFLYYLQNGKDMYTDEELDIDHLSEYDIDHIIPQAFIKDDSLDNKVLTKSAKNRGKSDDVPSMEIVHNRKNFWRQLLKSKLISQRKFDNLTKAERGGLTNEDKARFIQRQLVETRQITKHVARMLDTRFNTKLDEAGNRIRDPKVNIITLKSNLVSQFRKDYQLYKIREINNYHHAHDAYINAVVATALLKKYPQLAPEFVYGEYPTYNSYNSRKSATEKVLFYSNIMNFFKRIVVHSKTGEVRIRPVIEVNKETGEIVWDKKSDFRTVRKVLSYPQVNVVKKTEVQNHGLDRGKPKGFYNANLSPRPKEGSVENLVPAKQSFDTKRYGGYAGISNSYAVLVNGIIEKGKKKSKAEVTEFQGISILARKDFDKNPKQYLLNLGYKDIKSIIKLPKYSLFELENGSRRMLASILSTNNKRGEIHKGNEMYLPDKFVTLLYHAMRVNRTLEPGHKKYVETHRHVFDELLIYILEYNEKIVGAKANGKRIVEAYSARKDTDNLEELCNSFINLLNLTALGSAVDFEFLGTKIPRYRDYTPSSLLKATLIHQSVTGLYETRIDLSKLGGD

SEQ ID NO: 586 - protein, 1122 aa, Streptococcus suis; identical to SEQ ID NO: 583

SEQ ID NO: 587 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 588 - protein, 1128 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKRLRLQIKQNISNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLLGNPIDITPENSKNKVVLQSLKPWRTDVYFNKATGKYEILGLKYADLQFEKGTGTYKISQEKYNDIKKKEGVDSDSEFKFTLYKNDLLLVKDTETKEQQLFRFLSRTLPKQKHYVELKPYDKQKFEGGEALIKVLGNVANGGQCIKGLAKSNISIYKVRTDVLGNQHIIKNEGDKPKLDF

SEQ ID NO: 589 - protein, 1121 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKEYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASIQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPVNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 590 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 591 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 592 - protein, 1122 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNSQITDEFINRYLEILTGKRKYYHGPGNEKSRTDYGRYRTNGETLDNIFGILIGKCTFYPDEFRAAKASYTAQEFNLLNDLNNLTVPTETKKLSKEQKNQIINYVKNEKVMGPAKLFKYIAKLLSCDVADIKGHRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNGPEIKSLKYYDSKLLGNPIDITPENSKNKVVLQSLKPWRTDVYFNKNTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 593 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 594 - protein, 1121 aa, Streptococcus thermophilus
MSDLVLGLDIGIGSVGVGILNKVTGEIIHKNSRIFPAAQAENNLVRRTNRQGRRLTRRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFVNRYLEILTGKRKYYHGPGNEKSRTDYGRYRTNGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILKRLGKQKTTSSSNKTKYIDEKLLTEEIYNPVVAKSIRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNDPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 595 - protein, 1122 aa, Streptococcus thermophilus
  Streptococcus thermophilus MTCC 5460
MSDLVLGLDIGIGSVGVGILNKVTGEIIHKNSRIFPAAQAENNVERRTNRQGRRLTRRKKHRRVRLNRLFEESGLITDFTKISINLNPYQLRVRGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNSQITDEFINRYLEILTGKRKYYHGPGNEKSRTDYGRYRTSGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKASSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKLSDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNGPEIKSLKYYDSKLLGNPIDITPENSKNKVVLQSLKPWRADVYFNKTTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 596 - protein, 1121 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLGNHIDITPKDSNNKVVLQSVSPWRADIYFNNTTGKYEILGLKYADLQFEKGTGTYKISQEKYNDIKKKEGVDSDSEFKFTLYKNDLLLVKETETKEQQLFRFLSRTMPKQKHYVELKPYDKQKFEGGEALIKVLGNVANGGQCIKGLGKSNISIYKVRTDVLGNQHIIKNEGDKPKLDF

SEQ ID NO: 597 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVCEINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 598 - protein, 1128 aa, Streptococcus vestibularis
  Streptococcus vestibularis ATCC 49124
MSDLVLGLDIGIGSVGVGILNKVTGEIIHKNSRIFPAAQAENNVERRTNRQGRRLTRRKKHRRVRLNHLFEESGLITDFTKVSINLNPYQLRVKGLIDELSNEELFIALKNMVKHRGISYLDDASDDGNSSVGDYAQIVKENSKQLETKTPGQIQLERYQKYGQLRGDFTVEEDGKKHRLINVFPTSAYRSEALRILQTQKEFNPQITDEFINRYLEILTGKRKYYHGPGNEKSRTDYGRYTTKKDSENEYITLDNIFGILIGKCTFYPEEYRAAKASYTAQEFNLLNDLNNLTVPTETKKLSEEQKNQIINYVKNEKAMGPAKLFKYIAKLLSCDVADIKGYRIDKSDKAEIHTFEAYRKMKTLETIDFEKMSRDQLDKLAYVLTLNTEREGIQEALDHEFADGNFSQEQIDELVQFRKANSSIFGKGWHNFSVKLMMELIPELYATSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGRAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKSLSNKKKEYLLTEEDISRFDVRKKFIERNLVDTRYASRVVLNALQEHFRAHKTDTKVSVVRGQFTSQLRRHWGIEKTRDTYHHHAVDALIIAASSQLNLWKKQKNTLVNYSENQLLDIETGELISDDEYKESVFKAPYQHFVDTLKSKEFEDSILFSYQVDSKFNRKISDATIYATRQAKVGKDKKDETYVLGKIKDIYSQTGYDAFIKIYQKDKSKFLMYRHDPQTFEKVIEPILENYPNKEMNEKGKEVPCNPFLKYKEEHGDYIRKYSKKGNGPEIKSLKYYDSKLGNHIDITPKDSNNKVVLQSVSPWRADVYFNKTTGKYEILGLKYADLQFEKGTGTYKISQEKYNVIKKKEGVDSDSEFKFTLYKNDLLLIKDTETKEQQLFRFLSRTKPNVKHYVELKPYDKQKFEGNESLINVLGAVAKGGQCQKGINKPNISIYKVRTDVLGNQHIIKNEGDKPKLDF

SEQ ID NO: 599 - protein, 1084 aa, Subdoligranulum sp.
  Subdoligranulum sp. 4_3_54A2FAA
MKNTLYGIGLDIGVASVGWAVVGLNGTGEPVGLHRLGVRIFDKAEQPKTGESLAAPRRMARGMRRRLRRKALRRADVYALLERSGLSTREELAQMFEAGGLEDIYALRTRALDEPVGKAEFSRILLHLAQRRGFKSNRRTASDGEDGRLLAAVNENRRRMAQGGWRTVGEMLYRHEAFALHKRNKADDYLSTVGRDMVAEEASILFERQRAMGCSWAAPELQAEYLSILLRQRSFDEGPGGNSPYGGNQVEKMVGRCTFEPDEPRAAKAAYSFEYFSLLQKLNHIRLAENGETRPLTQPQRQQLLSLAHKTPDISLARIRKELALPETVQFNGVRCRANETLEESEKKEKFACLPAYHKMRKALDGVVKGRISSLSISQRDAAATALSLYKNEDTLRAKLTEAGFQAPEIDALAGLTGFSKFGHLSLKACRKLIPHLEQGLTYDQACTAAGYDFKGHGAGERAFTLPAAAPEMEQITSPVVRRAVAQTIKVVNGIIREMDASPAWVRIELARELSKTFGERQEMDRSMRENAAQNERLMQELRDTFHLLSPTGQDLVKYRLWKEQDGVCAYSLRRLDVERLFEPGYVDVDHIVPYSLSFDDRRSNKVLVLSSENRQKGNRLPLQYLQGKRREDFIVWTNSSVHDYRKRQNLLREKLSGDEAEGFRQRNLQDTQHMARFLYNYISDHLAFAQSEALGKKRVFAVSGAVTSHLRKRWGLSKVRADGDLHHALDAAVVACTTDGMIRRISGYYGHIEGEYLQDADGAGSQHARTKERFPAPWPRFRDELIVRLSEQPAEPLLDINPEFYCEYGTEHIRPVFVSRMPRRKVTGPGHKETIKGAAAADEGLLTVRKALTELKLDKDGEIKDYYMPSSDTLLYEALKAQLRRFGGDGKKAFAEPFYKPKADGTPGPLVRKVKTTEKATLTVPVHGGAASNDTMVRVDVFLVPGDGYYWVPVYTADTLKPELPNRAVVQGKPYSEWKEMREEDFIFSLYPNDLVYVEHKSGLKFTLQNADSTLEKTRTQTSAFAYFVSGSISTASITIRTHDNAYGIPSLGVKTLKTFHKYQVDVLGNVFPVHKETRQKFR

SEQ ID NO: 600 - protein, 1422 aa, Sutterella wadsworthensis
  Sutterella wadsworthensis 3_1_45B
MTQSERRFSCSIGIDMGAKYTGVFYALFDREELPTNLNSKAMTLVMPETGPRYVQAQRTAVRHRLRGQKRYTLARKLAFLVVDDMIKKQEKRLTDEEWKRGREALSGLLKRRGYSRPNADGEDLTPLENVRADVFAAHPAFSTYFSEVRSLAEQWEEFTANISNVEKFLGDPNIPADKEFIEFAVAEGLIDKTEKKAYQSALSTLRANANVLTGLRQMGHKPRSEYFKAIEADLKKDSRLAKINEAFGGAERLARLLGNLSNLQLRAERWYFNAPDIMKDRGWEPDRFKKTLVRAFKFFHPAKDQNKQHLELIKQIENSEDIIETLCTLDPNRTIPPYEDQNNRRPPLDQTLLLSPEKLTRQYGEIWKTWSARLTSAEPTLAPAAEILERSTDRKSRVAVNGHEPLPTLAYQLSYALQRAFDRSKALDPYALRALAAGSKSNKLTSARTALENCIGGQNVKTFLDCARRYYREADDAKVGLWFDNADGLLERSDLHPPMKKKILPLLVANILQTDETTGQKFLDEIWRKQIKGRETVASRCARIETVRKSFGGGFNIAYNTAQYREVNKLPRNAQDKELLTIRDRVAETADFIAANLGLSDEQKRKFANPFSLAQFYTLIETEVSGFSATTLAVHLENAWRMTIKDAVINGETVRAAQCSRLPAETARPFDGLVRRLVDRQAWEIAKRVSTDIQSKVDFSNGIVDVSIFVEENKFEFSASVADLKKNKRVKDKMLSEAEKLETRWLIKNERIKKASRGTCPYTGDRLAEGGEIDHILPRSLIKDARGIVFNAEPNLIYASSRGNQLKKNQRYSLSDLKANYRNEIFKTSNIAAITAEIEDVVTKLQQTHRLKFFDLLNEHEQDCVRHALFLDDGSEARDAVLELLATQRRTRVNGTQIWMIKNLANKIREELQNWCKTTNNRLHFQAAATNVSDAKNLRLKLAQNQPDFEKPDIQPIASHSIDALCSFAVGSADAERDQNGFDYLDGKTVLGLYPQSCEVIHLQAKPQEEKSHFDSVAIFKEGIYAEQFLPIFTLNEKIWIGYETLNAKGERCGAIEVSGKQPKELLEMLAPFFNKPVGDLSAHATYRILKKPAYEFLAKAALQPLSAEEKRLAALLDALRYCTSRKSLMSLFMAANGKSLKKREDVLKPKLFQLKVELKGEKSFKLNGSLTLPVKQDWLRICDSPELADAFGKPCSADELTSKLARIWKRPVMRDLAHAPVRREFSLPAIDNPSGGFRIRRTNLFGNELYQVHAINAKKYRGFASAGSNVDWSKGILFNELQHENLTECGGRFITSADVTPMSEWRKVVAEDNLSIWIAPGTEGRRYVRVETTFIQASHWFEQSVENWAITSPLSLPASFKVDKPAEFQKAVGTELSELLGQPRSEIFIENVGNAKHIRFWYIVVSSNKKMNESYNNVSKS

SEQ ID NO: 601 - protein, 1049 aa, Tistrella mobilis
MINERLTFGIDLGIGSCGWAVLRHADAAGEPGVIEGLGSWCFDVPETSKERIPTNQVRRSNRLLRRVIRRRRNRMAEIRRLFHAQGLLPSADEDALKRPRLDPWELRARGLDQCLSAEEFAVALGHIARHRGFRSSAKRKAANTSGEDSKMLSALLVTRERTARYRTVGEMFARDPEYSARRRNRDGIFDRTVARDDLIHEVGKLFEAQRARGSAFASPDLEADFNAIAFRQAEMQDSERLVGNCPFERDEKRAARWAPSFERFRLLTRLINLRIATAEGERRFTPEDLARVSAELGATAKLPVSRVRALIGLLPDERFTTIRVEDEDRDIVARTGEAAPGTWRLRKTLGEALWAEMQARPDQLDAIAHVLSFFEATAKIRSELDRLGLPAAVIEALDRGLEDGAFAKFKGAGHISAKACRNLLPHLQQGHRYDQACRLAGYDHAASTLSHTAQVVSKAGFNALVTELGESIANPIARKALTEGLKQIRAMCARWGLPGAIHIELAREVGNSIEKRRELESQRETTTKRRQTERDEIRGLLALEDVDDDTLLRYRLWKEQGGKCLYTGKDIHVRQLIATDNSVQVDHILPWSRFGDDSFNNKTLCLASANQRKRGQTPWEWFSLTGTPEAWEVFASRVETSKDLRGFKKRNLLLKNADEVAQRFRSRNLNDTRYAARLLAEAAKLFYPAGDRQEKDGRRRVLTRPGPLTAALRHAWGLESLKKADGKRVSDDRHHALDALAVAAISEREVQRLTRSFQEWEQQGLARPLRHVAPPWPGFRGDVLAAYAQAFVARPERRRARGKGHDASIRQVVGEGPEAQVFERRGLADLKEADLDRVKDPERNQAIIEAVRAWILAGRPADAPPRSPRGDVIVKLRTAPAKKIKPAVPVRGGTADRGDMVRIDVFTRPNRKGRDEWYLVPIYPHQVMNRKAWPHPPMRSVVAYKDEAGWTEIGAEHSFRFSLYPRSYVQLVKSNGDVIEGYLVSMDRSTGAFRVFVHNNPAEMAKGIGAKTLLNLRKFNVDRFGVRTEVKSEVRTWHGEVCTSPVPPD

SEQ ID NO: 602 - protein, 1395 aa, Treponema denticola
  Treponema denticola AL-2
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNDEVLYFKKIIRFSEIRSQREKIGKTISPYEDLSFRSYIKENLCKKTKNDEIGEKEFYDLLQKKNLEIYDMLLTKHKDTIYKKRPNSATIDILVKGKEKFKSLIIENQFEVILEILKLFSATRNVSELQHIGGSKYSGVAKIGNKISSLDNCILIYQSITGIFEKRIDLLKV

SEQ ID NO: 603 - protein, 1395 aa, Treponema denticola
  Treponema denticola ASLM
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPLYAEDKTILQENTLFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDGLVKPLFLSPSVKKMLWQTLKLVKEISHITQAPPKKIFIEMAKGAELDPVRTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKFNRLTRATPISDDETAKFIARQLVETRQATKVAARVLEKMFPETKIVYSKAETVSMFRNKFDIVKCREINDFHHAHDAYLNIVVGNVYNTKFTNNLWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNDEVLYFKKIIRFSEIRSQREKIGKTISPYEDLSFRSYIKENLCKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 604 - protein, 1395 aa, Treponema denticola
  Treponema denticola ATCC 35405
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 605 - protein, 1395 aa, Treponema denticola
  Treponema denticola H1-T
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKVNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNLDNCILIYQSITGIFEKRIDLLKV

SEQ ID NO: 606 - protein, 1395 aa, Treponema denticola
  Treponema denticola H-22
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENTLFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVIKKEKSPSGKTTPWNFFDHIDKDKTAEAFITSRTNFCTYLVGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYNGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGAFSNISKYGGYNKVSAAYYTLIEYEEKGNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNPDNCILIYQSITGIFEKRIDLLKV

SEQ ID NO: 607 - protein, 1395 aa, Treponema denticola
  Treponema denticola OTK
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPLYAEDKTILQENTLFNDKDFTDKTYHKAYPTINHLIKAWIENKVKPDPRLLYLACHNIIKKRGHFLFEGDFDSENQFDTSIQALFEYLREDMELDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSAYVGVCKITHKKLVIKNSASQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYNGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKLNRLTRTSPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPLSNISKYGGYNKVSAAYYTLIEYEEKGSKIRSLETIPLYLVKDIQKNKDGLKSYLTDQIGKKEIKILIPKIKINSLLKINGFPCHITGKMGEAFVLRPAVQFCCSNDEALYFKKIIRFNEIRKQREKMGKTISPYEDLSFRSYIKDNLCKKTKADEIEEKEFYDLLQKKNLEIYDMLLTKHKDTIYKKRPNSATIDILVKGKEKFKSLIIENQFEVILEILKLFSATRNVSDLQHIGGSKNAGNARVGNKISSLDNCILIYQSITGIFEKRIDLLKI

SEQ ID NO: 608 - protein, 1395 aa, Treponema denticola
  Treponema denticola SP37
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENALFNDRDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPNDYKKVFGYNKNEKNNNNYSAYVGVCKTKSKKLVINNTVNQEDFYKFLKPILLAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVIKKEKSPSGKTTPWNFFDHIDKDKTAEAFITSRTNFCTYLVGESVLPKNSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDSLVKPLFLSPSVKKMLWQTLKLVKEISHITQAPPKKIFIEMAKGAELDPVRTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKLNRLTRTSPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPLSNISKYGGYNKVSAAYYTLIEYEEKGSKIRSLETIPLYLVKDIQKNKDGLKSYLTDQIGKKEIKILIPKIKINSLLKINGFPCHITGKMGEAFVLRPAVQFCCSNDEALYFKKIIRFNEIRKQREKMGKTISPYEDLSFRSYIKDNLCKKTKADEIEEKEFYDLLQKKNLEIYDMLLTKHKDTIYKKRPNSATIDILVKGKEKFKSLIIENQFEVILEILKLFSATRNVSDLQHIGGSKNAGNARVGNKISSLDNCILIYQSITGIFEKRIDLLKI

SEQ ID NO: 609 - protein, 1062 aa, Treponema sp.
  Treponema sp. JC4
MIMKLEKWRLGLDLGTNSIGWSVFSLDKDNSVQDLIDMGVRIFSDGRDPKTKEPLAVARRTARSQRKLIYRRKLRRKQVFKFLQEQGLFPKTKEECMTLKSLNPYELRIKALDEKLEPYELGRALFNLAVRRGFKSNRKDGSREEVSEKKSPDEIKTQADMQTHLEKAIKENGCRTITEFLYKNQGENGGIRFAPGRMTYYPTRKMYEEEFNLIRSKQEKYYPQVDWDDIYKAIFYQRPLKPQQRGYCIYENDKERTFKAMPCSQKLRILQDIGNLAYYEGGSKKRVELNDNQDKVLYELLNSKDKVTFDQMRKALCLADSNSFNLEENRDFLIGNPTAVKMRSKNRFGKLWDEIPLEEQDLIIETIITADEDDAVYEVIKKYDLTQEQRDFIVKNTILQSGTSMLCKEVSEKLVKRLEEIADLKYHEAVESLGYKFADQTVEKYDLLPYYGKVLPGSTMEIDLSAPETNPEKHYGKISNPTVHVALNQTRVVVNALIKEYGKPSQIAIELSRDLKNNVEKKAEIARKQNQRAKENIAINDTISALYHTAFPGKSFYPNRNDRMKYRLWSELGLGNKCIYCGKGISGAELFTKEIEIEHILPFSRTLLDAESNLTVAHSSCNAFKAERSPFEAFGTNPSGYSWQEIIQRANQLKNTSKKNKFSPNAMDSFEKDSSFIARQLSDNQYIAKAALRYLKCLVENPSDVWTTNGSMTKLLRDKWEMDSILCRKFTEKEVALLGLKPEQIGNYKKNRFDHRHHAIDAVVIGLTDRSMVQKLATKNSHKGNRIEIPEFPILRSDLIEKVKNIVVSFKPDHGAEGKLSKETLLGKIKLHGKETFVCRENIVSLSEKNLDDIVDEKIKSKVKDYVAKHKGQKIEAVLSDFSKENGIKKVRCVNRVQTPIEITSGKISRYLSPEDYFAAVIWEIPGEKKTFKAQYIRRNEVEKNSKGLNVVKPAVLENGKPHPAAKQVCLLHKDDYLEFSDKGKMYFCRIAGYAATNNKLDIRPVYAVSYCADWINSTNETMLTGYWKPTPTQNWVSVNVLFDKQKARLVTVSPIGRVFRK

SEQ ID NO: 610 - protein, 1011 aa, Unknown
  Description of Unknown: uncultured delta proteobacterium HF0070_07E19 polypeptide
MSSKAIDSLEQLDLFKPQEYTLGLDLGIKSIGWAILSGERIANAGVYLFETAEELNSTGNKLISKAAERGRKRRIRRMLDRKARRGRHIRYLLEREGLPTDELEEVVVHQSNRTLWDVRAEAVERKLTKQELAAVLFHLVRHRGYFPNTKKLPPDDESDSADEEQGKINRATSRLREELKASDCKTIGQFLAQNRDRQRNREGDYSNLMARKLVFEEALQILAFQRKQGHELSKDFEKTYLDVLMGQRSGRSPKLGNCSLIPSELRAPSSAPSTEWFKFLQNLGNLQISNAYREEWSIDAPRRAQIIDACSQRSTSSYWQIRRDFQIPDEYRFNLVNYERRDPDVDLQEYLQQQERKTLANFRNWKQLEKIIGTGHPIQTLDEAARLITLIKDDEKLSDQLADLLPEASDKAITQLCELDFTTAAKISLEAMYRILPHMNQGMGFFDACQQESLPEIGVPPAGDRVPPFDEMYNPVVNRVLSQSRKLINAVIDEYGMPAKIRVELARDLGKGRELRERIKLDQLDKSKQNDQRAEDFRAEFQQAPRGDQSLRYRLWKEQNCTCPYSGRMIPVNSVLSEDTQIDHILPISQSFDNSLSNKVLCFTEENAQKSNRTPFEYLDAADFQRLEAISGNWPEAKRNKLLHKSFGKVAEEWKSRALNDTRYLTSALADHLRHHLPDSKIQTVNGRITGYLRKQWGLEKDRDKHTHHAVDAIVVACTTPAIVQQVTLYHQDIRRYKKLGEKRPTPWPETFRQDVLDVEEEIFITRQPKKVSGGIQTKDTLRKHRSKPDRQRVALTKVKLADLERLVEKDASNRNLYEHLKQCLEESGDQPTKAFKAPFYMPSGPEAKQRPILSKVTLLREKPEPPKQLTELSGGRRYDSMAQGRLDIYRYKPGGKRKDEYRVVLQRMIDLMRGEENVHVFQKGVPYDQGPEIEQNYTFLFSLYFDDLVEFQRSADSEVIRGYYRTFNIANGQLKISTYLEGRQDFDFFGANRLAHFAKVQVNLLGKVIK

SEQ ID NO: 611 - protein, 1032 aa, Unknown
  Description of Unknown: uncultured Termite group 1 bacterium phylotype Rs-D17 polypeptide
MLYHIANHRGTDSVRSFLEYDDDKIKENTLTAKIAKETKKVIDAKKYRTFGEYLYKGKIEKFQQNIRKKVSNRKTPANKNKEFAVTRDVIIKETEKILASQKQYYTYILTDEYIKKIKDAISYQTEKLIPESGYCPYFKDEKRLPRSHKLNEYRRMYEALNNAKYFDPVLDENTGEILSYQEKEFSREEKKILFDEVLLKGMELTESGAKKLLYHLPDGCEVQLQGRDKTTQKIKGYALVDLEASPFWLRLSQQQQDEFLYDWNSLPLEKLKPKLTNYYSLTESEVDETFQEIKLPSNYASVGKKAMEILLTYIKDGCSYTEALEKAVSEGKLKVDKQTMIYDSLPYYGKILKESTQKLIGKAFSKQFADRNYKEPDTNKNEREFGKIANPVVHQTLNELRKLINEIITVFGKKPLEIGLETTRELKKSKKNREYLSKQQNKNEYARNRIYKEYIEPHLSQIKSRQENPSKYISKFELLEEQNFICPFCSEKITPDDIINSKVDVEHIFPIEESEDITKNNLVIAHNECNADKGKKSPFDAFGDKTSGKYRWNCILHNAQKNLPHKVWRFYQGSLEKFLENKPMSRRFGTDNSYISKIAARYLACLFNDPYHSEIFCIKSSLIAQLRIAWDLNSIMVPLVKNILSEKELEEFKISKNKKIRIDNRHHALDAIVIAYANRGYHNFLNRIHAKEYKINYREKSWLSKILLPPLNRDLEDFKISVKDSIEKANVSIKHDHNTNGSLVKATAYKVYYSGAGEYIITTSKNVEEISFKEKEDPKDTLYRALCKFECRDIDIKDEKLIKKLKYNSTLYKKVQNNLSKAKQELEQDNKKTEEEGKKSQKITEVRIYKKACSLVKGQYIQCGSRLKDKFFAVKEPTEIKTGLGYDTGDNLFLDLYYDKTGKLCGEIIRKVNFNRNKPNYQKEGYTLFERIYQSDILEVDTSEDRISLKNKTGSAPSDRTFIKVNTFTEVNAYFDGKRDKIQIFFGNLLKSSFKNDSFFISSMQKYNVRKVILTSLGIIKYRSQILKNKEV

SEQ ID NO: 612 - protein, 1398 aa, Veillonella atypica
  Veillonella atypica ACS-134-V-Col7a
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLSNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 613 - protein, 1398 aa, Veillonella parvula
  Veillonella parvula ATCC 17745
METQASNQLISSHLKGYPIKDYFVGLDIGTSSVGWAVTNKAYELLKFRSHKMWGSRLFDEGESAVARRGFRSMRRRLERRKLRLKLLEELFADAMAQVDPTFFMRLRESKYHYEDKTTGHSSKHILFIDKNYNDQDYFKEYPTVYHLRSELMKSGTDDIRKLFLAVHHILKYRGNFLYEGATFDSNASTLDDVIKQALENITFNCFDCNSAISSIGQILMEAGKTKSDKAKAIEHLVDTYIATDTVDTSSKTQKDQVKEDKKRLKAFANLVLGLNASLIDLFGSVEELEEDLKKLQITGDTYDDKRDELAKAWSDEIYIIDDCKSVYDAIILLSIKEPGLTISESKVKAFNKHKDDLAILKSLLKSDRSIYNTMFKVDEKGLHNYVHYIKQGRTEETSCNREDFYKYTKKIVEGLSDSKDKEYILSQIELQILLPLQRIKDNGVIPYQLHLEELKAILAKCGPKFPFLNEVADGFSVAEKLIKMLEFRIPYYVGPLNTHHNVDNGGFAWAVRKASGRVTPWNFDDKIDREKSAAAFIKNLTNKCTYLLGEDVLPKSSLLYSEFMLLNELNNVRIDGKPLEKVVKEHLIEAVFKQDHKKMTKNRIEQFLKDNGYISETHKHEITGLDGEIKNDLASYRDMVRILGDGFDRSMAEEIITDITIFGESKKMLRETLRKKFASCLDDEAIKKLTKLRYRDWGRLSQKLLNGIEGCDKAGDGTPETIIILMRNFSYNLMELLGDKFSFMERIQEINAKLTEGQIVNPHDIIDDLALSPAVKRAVWQALRIVDEVAHIKKALPARIFVEVTRSNKNEKKKKDSRQKRLSDLYAAIKKDDVLLNGLNNEIFGELKSSLAKYDDAALRSKKLYLYYTQMGRCAYTGEIIELSLLNTDNYDIDHIYPRSLTKDDSFDNLVLCKRTANAQKSDAYPISEEIQKTQKPFWTFLKQQGLISERKYERLTRITPLTADDLSGFIARQLVETNQSVKAATTLLRRLYPGVDVVFVKAENVTDFRHDNNFIKVRSLNHHHHAKDAYLNIVVGNVYHERFTRNFRAFFKKNGANRTYNLAKMFNYDVNCTNAKDGKAWDVKTSMDTVKKMMDSNDVRVTKRLLEQTGALADATIYKATVAGKAKDGAYIGMKTKSSVFADVSKYGGMTKIKNAYSIIVQYTGKKGEVIKEIVPLPIYLTNRNTTDQDLINYVASIIPQAKDISIIYGKLCINQLVKVNGFYYYLGGKTNSKFCIDNAIQVIVSNEWIPYLKVLEKFNNMRKDNKDLKANVVSTRALDNKHTIEVRIVEEKNIEFFDYLVSKLKMPIYQKMKGNKAAELSEKGYGLFKKMSLEEQSIHLIELLNLLTNQKTTFEVKPLGITASRSTVGSKISNQDEFKVINESITGLYSNEVTIV

SEQ ID NO: 614 - protein, 1395 aa, Veillonella sp.
  Veillonella sp. 6_1_27
METQASNQLISSHLKGYPIKDYFVGLDIGTSSVGWAVTNKAYELLKFRSHKMWGSRLFDEGESAVARRGFRSMRRRLERRKLRLKLLEELFADAMAQVDPTFFMRLRESKYHYEDKTTGHSSKHILFIDKNYTDQDYYKEYPTIYHLRVALMKSGTDDIRKLFLAVHHILKYRGNFLYEGATFDSNASTLDDVLKQALENITFNCFDSSAAIGSIGQILMELGKTKSDKAKAIERLVDTYIITDEVDTSGKTQKEQVKEDKKRLKSFANLVLGLSASLTDLFGSVEDLDEDLKKLQIIGDTYDERRDDLAKVWGDEIHIIDDCKSVYDAIILMSIKEPGLTISESKVKAFKKHKDDLAILKSLLKSDRSIYNTMFKVDEKGLHNYVHYIKQGRTEETSCNREDFYKYTKKVVEGLPDSKDKEYILSEIELQTLLPLQRIKDNGVIPYQLHLEELKVILAKCGPKFPFLNEVADGFSVAEKLIKMLEFRIPYYVGPLNTHHNVDNGGFAWAVRKASGRVTPWNFDDKIDREKSAAAFIKNLTNKCTYLLGEDVLPKSSLLYSEFMLLNELNNVRIDGKPLEKAVKEHLIEAVFKQDHKKMTKNRIEQFLKDNNYIPEKHKPEITGLDGEIKNDLASYRDMVRILGNNFDLSMAEEIITDITIFGESKKMLRETLRNKFSSRLDDEAIKKLSKLRYRDWGRLSRKLLNVIEGCDKAGDGTPETIIILMRNFSYNLMELLGDKFSFMERIQEINAKLIEGQIVNPHDIIDDLALSPAVKRAVWQALRIVDEIVHIKKTLPARIFVEVTRSNKAEKKKKDSRQKRLSDLYAAIKKDDALLSGLTNEEFGGLKSGLAKYDDAALRSKKLYLYYTQMGRCAYTGEVIDLSQLNTDNYDIDHIYPRSLTKDDSFDNLVLCKRTANAQKSDTYPISKEIQKAQKAFWIFLKQQGLISERKYERLTRITPLTADDLSGFIARQLVETNQSVKAATTLLRRLYPGVDVVFVKAENVTDFRHDNDFIKVRSLNHHHHAKDAYLNIVVGNVYHERFTRNFRAFFKKNGANRTYNLAKMFNYDVKCTNAKDGKAWAVKTSMDTVKKMMDSNDVRVTKRVYEQKGQLSDINLTKASKVKADIYLPIKANDPIMSQNMKYGGYSDIKNAYYTIIEYSDKKNNSIKAFIPIPIFIATKTLTKQALLEYIKTVLPKANNLRIIYKKVYNDQLLKIDGFNYYLGGRSNDRFCIDNAIQLIVPLEIQFYIKLVEKFTAIISENKNIALKASSVKSRNPINNQVENITLEYTQKLFDYLVSKFNELIYLKMRGNKLTDVNNIGRKQFIKLSLEERCKALAELLNIFTNMNKKLSLSTINVSASRKVVNFKISSLDEFKIVNESITGLYSHEITIV

SEQ ID NO: 615 - protein, 1120 aa, Veillonella sp.
  Veillonella sp. oral taxon 780 str. F0422
MGFKANLVNLFTDEDIEVILPEEKEFKSINLHEGIYEDVRDAYEDAWGDRFAIVDQCKVLHDIIVISSIIKPGQSLSEAKIESYNQHKEDLVLLKSVLKEDRKLYDDMFVVDTDKGTNYVKYTKQGVNGNTSATQEEFYKYVRKVVSVLPETEHTRRIVQKLEEGTFLPLQRISKNGVVPYQLHKEELVRILDKATVNFPFLNKVENGLTVADKIISILEFKIPYYVGPLNPTHSIENGGFAWVVRKEAGQVLPWNFEQKVDVQASAVKFIENLTNKCTYLIDQDVLPKYSLLYAEFSLLNELNNIRVNDKPLPADVKQAFIRDHFISLQDSKTATKKVVAKYLVDNNYVSQPPIITGMDQQIATKLTSHRDMTRILGEHFDHAMAEDIIRYITIFGESKDMLRQVLKNYYGDRLTTEQIKKLGKLTYTGWGRLSKKFLSDIWGMKKNDDDAEAGTIIEHMREGQENLMQLLSSSYSFIDVVQEYVTNVLGEKEKTAFEMLEDLSLSPMVKRSVWQTLRILDEIVSIRKELPKKIFVEVARTNKADKKRTQSRKALLEELYKQIKDEDVHVLQQELESKEDSALNSKKLYLYFTQMGRCMYSGRRIDIHELFTDKYDIDHIYPRSLTKDDSWHNIVLVEKQLNAEKTDRFPILSAIQSKQKGFWKLLWDRGFISEKKYDRLVRTTDLTDEELNQFINRQMVSTNQSVKAVTTLLHQLYPETEVVFSKAENVSDFRHDYDFVKVRSINHHHHAKDAYLNIVVGNVYHEKFTKNFLSFAKQKGTRRTYNLTKIFEYEIKLTEESKKVIWDPNIHMDIVKKMMKSNDVRVTQRAVPQKGGLSDETIYKKGIAKRGVYLPLKSSDERVRDVEKYGGRTSITISEYIILNIRDTSDQDRIEIFSLPLYIAGKKDIHKAIEEAYLSTCKKPASVVDIQILYRGLYIGSKVNINGFTYYMGGKTGSNVSIDSAVDVVMDITSSVYIKLLEKVAIKKIENPKTFRIENIKTSYNHKEVTVSKEQNIALYQELLKKLDTPLFSKMKGNKLEEFRTVGFDTFIALSLEEQASVLLEVLNVLTNFKTKRDITKIGMTSSRSTLGINISNTEQFSVITTSITGLYEQEIKIK

SEQ ID NO: 616 - protein, 1068 aa, Verminephrobacter eiseniae
MNKAVAYRLALDLGSTSLGWAIFRLNEAREPTAIIRAGVRIFSDGRNANSEPLAVHRRVARAMRRRRDRLLKRKKRMHDQLVQHGFFPAEVAERKELERLNPYQLRAKGLHEALTPGEFARALFHINQRRGFKSNRKTDRKDNDSGALKQAISELRKRIQDSDCATAGEWFWKERMQQKPEGVRGQWVRARYRKTPSTTDEGKKRIGYDLYVDRAMVEQEFDALWAAQAALQPGLFTEAARAELKDTLLYQRDLRPVKPGRCTLLPAEERAPLALPSTQRFRILQEVNNLRLLDEALREVPLNLAQRDAVVSALEGKKELSFAAIRKLLTLSGKFNLEDEKRAELKGNATSVILARKDLFGDAWAGFDAAVQDEIVWRLVSQESEGALIAWLQQHTGVDGVCAEAIVNTRLPDGYGRLSRKALERIVPALQREVCTYDKAVQAAGFAHHSDLGFDFDYAEDEVQQVGEHTIASTGEVQAQYAFKQLPYYGKALQRHVAFGSGDAKDHEEKCYGKIANPTVHIGLNQVRTVVNALIRRYGHPTEVVVELARDLKQSREQKQQTQREQADNQKRNEDIRKRIAPILETSPERVRDRDIKKWILWEELNKKDIADRHCPYSGERISATMLLSEAVEIEHILPFSRTLDDSLNNRTVAMRRANRIKGDRTPWEARADFEAQGWRYEAILQRAEGMPPRKRYRFAEDGYQRWLGKDRNFLARALNDTSYLSRLAANYLRLVCPQGVRVIPGQMTDKLRGKFGLNSVLGLDGKKNRNDHRHHAVDACVIGVTDQGLMQRFANASKQARENGLTRLVQDMLLPWWPSYYDHVERAVRHIRVSHRPDHGFEGAMMKGTAHGIREDGIREDGRIKQRPKAKGSADHKTITLIPIDEPRQLARHGVDAEGKPLPYKGYASGSNYCIEITKNGKGKWEGQVISTFDAYRIKAAADAAARAGQVISTVEADSIVRKSGWERLRGAQSQNGQPLVMRLVIGDSVRMEVDGRDEVMRVVKMSGKEMVFAPVREANVDKRNNMPDEQDPFTYTYKRADQLRKAKARQVTISPIGELRDPGFKG

SEQ ID NO: 617 - protein, 1440 aa, Weeksella virosa
MKTILGLDLGTNSIGWALVEQDFENKQGLILGMGSRIIPMDAGIIGKFAEGSSISQTAERTGYRSIRRLRERHLLRRERLHRVLNILKFLPEHYAAEIDFEKRFGQFLAETEPKLAWKKNAEGKFEFLFQRSFDEMVADFKANGQDIKIPYDWTIYYLRKKALTQKISPQELAWIILNFNQKRGYYQLRGEEEEENPNKKVEFYSLKIVDVVADEQPNKKGDTWYSLHLENGWVYRRSSKIPLYDWKDKVRDFIVTTDINEDGSEKLDKDGEVKRSFRAPKEDDWTLIKKKTEQEIEQFNQTVGSYIYEALLDNPTQKIRGKLVRTIERKFYKSELKKILEKQIELQPELFTEDLYNACARELYRRNVAHQQQLSSRDFVYLFLNDIIFYQRPLRSQKSLISNCSLEFRTIKDKDGNGQIIYLKAIPKSNPYYQEFRVWQWLYNLKIFTKEDDKDVTNQFINKVEDLEALFEFLMNQKEVNHTDILTYLIEPIVKSKYPNAKGKAFKDELKKELKKYRWNYVYDADKDESKSYPMNETRYELRKRLDKVENVPADFMTRKIEQHLWHIIYSVTDKIEFEKALKSFANKYDLHQESFVENFKRFKPFDSDYGTYSEKAIKKLLPLMRVGKYWSWDIIDDKTKTRIGKIITGEYDETIKNRVREKAIDLTEENHFQGLQLWLAQYIVYDRHSEADIAGKWNSVADLEQYLSEFKQHSLRNPIVEQVITETLRVVRDIWKQYGKGAKDYFDEIHIELGREMKNTAEERKRLSSIISENETTNLRIRAILEELMYDENMENVRPYSPMQQEALKIYEDGVLSSSVEIPEDIEKISKKSEPTKSEIQRYKLWLEQKYRSPYTGRPIPLSKLFTPAYQIEHIIPQARFFDDGFSNKVICESEVNALKDKMLGLEFIQNYYGQKVTTSFGEVTILTEDAYKAFVKEHYDKNRSKRNKLLLEEIPEKMIDRQMNDTRYISKYISKVLSNLVRGEKDDEGVNSKNIIPGNGKITGILKQDWGLNDVWNDLILPRFERMNQLTNSTDFTAWNEKHQKFLPSVPLELSKGFQKKRIDHRHHALDALIIACATRDHVNLLNNKHAKSRNERYDLQHKLRHTTPWQDKEGKVRTKFTEFKKPWETFTQDTKKELEKIVVNFKQNLRVINKATNYYEKIVDGKKVMFKQEGVNWAIRKPMHKETVSGKIDLPRVKVSKGKILTATRKSLDTSFNAKTILSITDTGIQKILLNYLKAKGNPELAFSPEGIEEMNQNISLYNDGKPHQPILKVRVFEQGSKFPLGETGNKTTKYVEAAKGTNLFFGVYEDNQGKRSYDTIPLNIVIERQKQGLNSVPETNEKGHRLLFSLSPNDLVYVPIEGEVFDETNPDVNRIYKVVSFSGSQMFCVRQDVATSIVYKLEFSSLNKMERTIDGIMIKEICIKLKVDRLGNISKA

SEQ ID NO: 618 - protein, 1409 aa, Wolinella succinogenes
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 619 - protein, 1059 aa, Wolinella succinogenes
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 620 - protein, 1388 aa, Zunongwangia profunda
MKRILGLDLGTNSIGWALVNEAENEKEISKIIKLGVRVNPLTIDEKTNFEKGRPLSTNADRTLKRGARRNLQRYKLRRENLIEILIDNHIITKETPLTEIGKGTTYQTLSLRAKAVRERIDLEDFAKVLLAINKKRGYKSSRKASNDEEGQAIDGMAIAKELYERGITPGQYVLELLENDRKYIPDFYRSDLKQEFNKIWNNQKTFYPEILTDELFKELDGKNKSQTWAICQKPFNIKGIKRITKGREKTIENYHWRVKGLSGKLNLEKLAIILQEINNDINQSSGYLGGISDKSKKLYLNKETVGEFLYKQIAKNPHTSLKNQVFYRHDYLDEFEQIWKTQSNFNANLTDELKQEIRDVIIFYQRKIKSQKSLISFCQFESWEQEYFDKETGKTKTRTVGRRVIPKSSPLFQEFKIWQNLNHLVFTNSETDEKIEIKEVEQEIRKELFEELNLRGDLNPNDLLKILRSQFKIGKLSNWKCNFEKIEGNRTNAALFNIYQKISDFEGYGIDWNKSNAKKIRKELKATFPEIGIDASILEFDAYKKQLTNQSSYELWHLLYSAEEDFKISEQDKLIYGNSSVSLKKKLHLKFGFNPEYAKMLANLSLMSDYGNLSAKAIKKILPYLEDGHLYSEACRLAGYNHSKSLTAEELEKFEPKAKLDLLKKNSLRNPVVEKILNQMVNVVNQVIDTYGKPDGVRIELARELKKSAKERAEMTKGIADGTRRNEEIKKIITQKFGIPNPTKSDLVRYRLWQELESRGYKDIFTDKYISPDKIFSSEIDIEHIIPKALLFDDSFSNKTLSFRNVNLKKANRTALDFITQDYQSNVEAYKERVETWNKDNHISKGKRNKLLMSLKDIPDGFIERDLRNSQYIARKAKRMLYEVFPNEVLATSGSITDKLRSDWDLINVMKELNLPKYKALGLTEYEERLDKGTEELFKHEVIKDWTKRNDHRHHAMDALAVAFTTHNHIQYINNLNARKDITQDNHPIIKNIENLITEVNSKGKRVFKAPMSSFRESAKEQIEAILVSFKNKNKVVTKNINQTKKEGGFNYQNAKTPRGQLHKETIYGKSKQPLEKPVKINNRFCKKQVGLIINFKEQEAVLHHLKKYDNNEKIAFSNKTLKSDPIQVNGSPLREVKIFEEIFTIRKDINPDNFKTQKHLDKIIDKGIKEVMKKRLEEYNGDFKTAFSDLDKNPIWLNQSKGITIKRATISGVTNAEPLHQAKDHLGNIILDDNGKEIPIDYVSTGNNHHVAIYQDESGNLQEEVVSFYEAVIRKNQDQPIIKKRHPKGWKFLFTMKQNEMFVFSSENFNPSEIDLLDEKNAAIISPNLFRVQKIATKNYMFRHHLETEVTNNLDFTYRHFQATEWLRNLCKVRIDHIGRIVQIGEY

SEQ ID NO: 621-631 - skipped (11 entries)

SEQ ID NO: 632 - RNA, 22 nt, Homo sapiens
ugcucagguugcacagcuggga

SEQ ID NO: 633 - RNA, 22 nt, Homo sapiens
ucccagcugugcaaccugagca

SEQ ID NO: 634 - RNA, 22 nt, Homo sapiens
ucagguguggaaacugaggcag

SEQ ID NO: 635 - RNA, 22 nt, Homo sapiens
cugccucaguuuccacaccuga

SEQ ID NO: 636 - RNA, 22 nt, Homo sapiens
caaaaccgcgauuacucuugca

SEQ ID NO: 637 - RNA, 22 nt, Homo sapiens
ugcaagaguaaucgcgguuuug

SEQ ID NO: 638 - RNA, 21 nt, Homo sapiens
aaaaguaauugugguuuuugc

SEQ ID NO: 639 - RNA, 21 nt, Homo sapiens
gcaaaaaccacaauuacuuuu

SEQ ID NO: 640 - RNA, 21 nt, Homo sapiens
aaaaacugcaaucacuuuugc

SEQ ID NO: 641 - RNA, 21 nt, Homo sapiens
gcaaaagugauugcaguuuuu

SEQ ID NO: 642 - RNA, 22 nt, Homo sapiens
caaaagugauugugguuuuugc

SEQ ID NO: 643 - RNA, 22 nt, Homo sapiens
gcaaaaaccacaaucacuuuug

SEQ ID NO: 644 - RNA, 22 nt, Homo sapiens
agcaguguuuguuuugcccaca

SEQ ID NO: 645 - RNA, 22 nt, Homo sapiens
ugugggcaaaacaaacacugcu

SEQ ID NO: 646 - RNA, 22 nt, Homo sapiens
ucgggcgcaagagcacugcagu

SEQ ID NO: 647 - RNA, 22 nt, Homo sapiens
acugcagugcucuugcgcccga

SEQ ID NO: 648 - RNA, 21 nt, Homo sapiens
acacuuguugggaugaccugc

SEQ ID NO: 649 - RNA, 21 nt, Homo sapiens
gcaggucaucccaacaagugu

SEQ ID NO: 650 - RNA, 24 nt, Homo sapiens
aggagcuauccacuccaggugucc

SEQ ID NO: 651 - RNA, 24 nt, Homo sapiens
ggacaccuggaguggauagcuccu

SEQ ID NO: 652 - RNA, 23 nt, Homo sapiens
ccagagcagccugcgguaacagu

SEQ ID NO: 653 - RNA, 23 nt, Homo sapiens
acuguuaccgcaggcugcucugg

SEQ ID NO: 654 - RNA, 22 nt, Homo sapiens
aguugccagggcugccuuuggu

SEQ ID NO: 655 - RNA, 22 nt, Homo sapiens
accaaaggcagcccuggcaacu

SEQ ID NO: 656 - RNA, 21 nt, Homo sapiens
uagaccaucuuucuagaguau

SEQ ID NO: 657 - RNA, 21 nt, Homo sapiens
auacucuagaaagauggucua

SEQ ID NO: 658 - RNA, 22 nt, Homo sapiens
agcucuagaaagauuguugacc

SEQ ID NO: 659 - RNA, 22 nt, Homo sapiens
ggucaacaaucuuucuagagcu

SEQ ID NO: 660 - RNA, 21 nt, Homo sapiens
gggacuaggaugcagaccucc

SEQ ID NO: 661 - RNA, 21 nt, Homo sapiens
ggaggucugcauccuaguccc

SEQ ID NO: 662 - RNA, 23 nt, Homo sapiens
aggucugcauucaaauccccaga

SEQ ID NO: 663 - RNA, 23 nt, Homo sapiens
ucuggggauuugaaugcagaccu

SEQ ID NO: 664 - RNA, 20 nt, Homo sapiens
cauuacagcacagccauucu

SEQ ID NO: 665 - RNA, 20 nt, Homo sapiens
agaauggcugugcuguaaug

SEQ ID NO: 666 - RNA, 21 nt, Homo sapiens
ucuggcugugcuguaaugcag

SEQ ID NO: 667 - RNA, 21 nt, Homo sapiens
cugcauuacagcacagccaga

SEQ ID NO: 668 - RNA, 21 nt, Homo sapiens
ugacuucuaccucuuccaaag

SEQ ID NO: 669 - RNA, 21 nt, Homo sapiens
cuuuggaagagguagaaguca

SEQ ID NO: 670 - RNA, 22 nt, Homo sapiens
uuggaauaggggauaucucagc

SEQ ID NO: 671 - RNA, 22 nt, Homo sapiens
gcugagauauccccuauuccaa

SEQ ID NO: 672 - RNA, 22 nt, Homo sapiens
ucguaucagagauuccagacac

SEQ ID NO: 673 - RNA, 22 nt, Homo sapiens
gugucuggaaucucugauacga

SEQ ID NO: 674 - RNA, 23 nt, Homo sapiens
acugggaugucacugaauauggu

SEQ ID NO: 675 - RNA, 23 nt, Homo sapiens
accauauucagugacaucccagu

SEQ ID NO: 676 - RNA, 22 nt, Homo sapiens
caaaguccuuccuauuuuuccc

SEQ ID NO: 677 - RNA, 22 nt, Homo sapiens
gggaaaaauaggaaggacuuug

SEQ ID NO: 678 - RNA, 21 nt, Homo sapiens
gaagaauaggagggacuuugu

SEQ ID NO: 679 - RNA, 21 nt, Homo sapiens
acaaagucccuccuauucuuc

SEQ ID NO: 680 - RNA, 22 nt, Homo sapiens
ugggccaugcauuucuagaacu

SEQ ID NO: 681 - RNA, 22 nt, Homo sapiens
aguucuagaaaugcauggccca

SEQ ID NO: 682 - RNA, 21 nt, Homo sapiens
ucuagaaaugcaugacccacc

SEQ ID NO: 683 - RNA, 21 nt, Homo sapiens
ggugggucaugcauuucuaga

SEQ ID NO: 684 - RNA, 22 nt, Homo sapiens
uuccacugccacuaccuaauuu

SEQ ID NO: 685 - RNA, 22 nt, Homo sapiens
aaauuagguaguggcaguggaa

SEQ ID NO: 686 - RNA, 21 nt, Homo sapiens
auuagguaguggcaguggaac

SEQ ID NO: 687 - RNA, 21 nt, Homo sapiens
guuccacugccacuaccuaau

SEQ ID NO: 688 - RNA, 21 nt, Homo sapiens
caccgacucugucuccugcag

SEQ ID NO: 689 - RNA, 21 nt, Homo sapiens
cugcaggagacagagucggug

SEQ ID NO: 690 - RNA, 22 nt, Homo sapiens
cagcaggggagagagaggaguc

SEQ ID NO: 691 - RNA, 22 nt, Homo sapiens
gacuccucucucuccccugcug

SEQ ID NO: 692 - RNA, 22 nt, Homo sapiens
uuccagcccuucuaaugguagg

SEQ ID NO: 693 - RNA, 22 nt, Homo sapiens
ccuaccauuagaagggcuggaa

SEQ ID NO: 694 - RNA, 22 nt, Homo sapiens
uaccauuagaagagcuggaaga

SEQ ID NO: 695 - RNA, 22 nt, Homo sapiens
ucuuccagcucuucuaauggua

SEQ ID NO: 696 - RNA, 21 nt, Homo sapiens
ucaagugucaucugucccuag

SEQ ID NO: 697 - RNA, 21 nt, Homo sapiens
cuagggacagaugacacuuga

SEQ ID NO: 698 - RNA, 23 nt, Homo sapiens
uuugggauugacgccacaugucu

SEQ ID NO: 699 - RNA, 23 nt, Homo sapiens
agacauguggcgucaaucccaaa

SEQ ID NO: 700 - RNA, 21 nt, Homo sapiens
cugccuguucuuccacuccag

SEQ ID NO: 701 - RNA, 21 nt, Homo sapiens
cuggaguggaagaacaggcag

SEQ ID NO: 702 - RNA, 23 nt, Homo sapiens
uauggaguggacuuucagcuggc

SEQ ID NO: 703 - RNA, 23 nt, Homo sapiens
gccagcugaaaguccacuccaua

SEQ ID NO: 704 - RNA, 22 nt, Homo sapiens
ccucaccaucccuucugccugc

SEQ ID NO: 705 - RNA, 22 nt, Homo sapiens
gcaggcagaagggauggugagg

SEQ ID NO: 706 - RNA, 23 nt, Homo sapiens
caggcagaaguggggcugacagg

SEQ ID NO: 707 - RNA, 23 nt, Homo sapiens
ccugucagccccacuucugccug

SEQ ID NO: 708 - RNA, 20 nt, Homo sapiens
ucucuucaucuaccccccag

SEQ ID NO: 709 - RNA, 20 nt, Homo sapiens
cugggggguagaugaagaga

SEQ ID NO: 710 - RNA, 21 nt, Homo sapiens
uuggaggguguggaagacauc

SEQ ID NO: 711 - RNA, 21 nt, Homo sapiens
gaugucuuccacacccuccaa

SEQ ID NO: 712 - RNA, 22 nt, Homo sapiens
cugccagccccguuccagggca

SEQ ID NO: 713 - RNA, 22 nt, Homo sapiens
ugcccuggaacggggcuggcag

SEQ ID NO: 714 - RNA, 23 nt, Homo sapiens
acaaaguacagcauuagccuuag

SEQ ID NO: 715 - RNA, 23 nt, Homo sapiens
cuaaggcuaaugcuguacuuugu

SEQ ID NO: 716 - RNA, 23 nt, Homo sapiens
aaaggucauuguaagguuaaugc

SEQ ID NO: 717 - RNA, 23 nt, Homo sapiens
gcauuaaccuuacaaugaccuuu

SEQ ID NO: 718 - RNA, 22 nt, Homo sapiens
ugaggcuaaugcacuacuucac

SEQ ID NO: 719 - RNA, 22 nt, Homo sapiens
gugaaguagugcauuagccuca

SEQ ID NO: 720 - RNA, 24 nt, Homo sapiens
uauagagagcaggaagauuaaugu

SEQ ID NO: 721 - RNA, 24 nt, Homo sapiens
acauuaaucuuccugcucucuaua

SEQ ID NO: 722 - RNA, 23 nt, Homo sapiens
gugcuucaucguaauuaaccuua

SEQ ID NO: 723 - RNA, 23 nt, Homo sapiens
uaagguuaauuacgaugaagcac

SEQ ID NO: 724 - RNA, 24 nt, Homo sapiens
guggaaagcaugcauccagggugu

SEQ ID NO: 725 - RNA, 24 nt, Homo sapiens
acacccuggaugcaugcuuuccac

SEQ ID NO: 726 - RNA, 22 nt, Homo sapiens
agacacauuuggagagggaacc

SEQ ID NO: 727 - RNA, 22 nt, Homo sapiens
gguucccucuccaaaugugucu

SEQ ID NO: 728 - RNA, 22 nt, Homo sapiens
uucccuuugucauccuaugccu

SEQ ID NO: 729 - RNA, 22 nt, Homo sapiens
aggcauaggaugacaaagggaa

SEQ ID NO: 730 - RNA, 21 nt, Homo sapiens
gcugggaaggcaaagggacgu

SEQ ID NO: 731 - RNA, 21 nt, Homo sapiens
acgucccuuugccuucccagc

SEQ ID NO: 732 - RNA, 21 nt, Homo sapiens
uaccacaggguagaaccacgg

SEQ ID NO: 733 - RNA, 21 nt, Homo sapiens
ccgugguucuacccuguggua

SEQ ID NO: 734 - RNA, 22 nt, Homo sapiens
ggcuggagcgagugcaguggug

SEQ ID NO: 735 - RNA, 22 nt, Homo sapiens
caccacugcacucgcuccagcc

SEQ ID NO: 736 - RNA, 18 nt, Homo sapiens
ccaggcucugcaguggga

SEQ ID NO: 737 - RNA, 18 nt, Homo sapiens
ucccacugcagagccugg

SEQ ID NO: 738 - RNA, 22 nt, Homo sapiens
cugggaggugugauauuguggu

SEQ ID NO: 739 - RNA, 22 nt, Homo sapiens
accacaauaucacaccucccag

SEQ ID NO: 740 - RNA, 22 nt, Homo sapiens
gggaggugugaucucacacucg

SEQ ID NO: 741 - RNA, 22 nt, Homo sapiens
cgagugugagaucacaccuccc

SEQ ID NO: 742 - RNA, 22 nt, Homo sapiens
ugugauaucaugguuccuggga

SEQ ID NO: 743 - RNA, 22 nt, Homo sapiens
ucccaggaaccaugauaucaca

SEQ ID NO: 744 - RNA, 22 nt, Homo sapiens
ugugauaucgugcuuccuggga

SEQ ID NO: 745 - RNA, 22 nt, Homo sapiens
ucccaggaagcacgauaucaca

SEQ ID NO: 746 - RNA, 18 nt, Homo sapiens
ggugggcuucccggaggg

SEQ ID NO: 747 - RNA, 18 nt, Homo sapiens
cccuccgggaagcccacc

SEQ ID NO: 748 - RNA, 18 nt, Homo sapiens
cacugcaggacucagcag

SEQ ID NO: 749 - RNA, 18 nt, Homo sapiens
cugcugaguccugcagug

SEQ ID NO: 750 - RNA, 17 nt, Homo sapiens
ugagggaggagacugca

SEQ ID NO: 751 - RNA, 17 nt, Homo sapiens
ugcagucuccucccuca

SEQ ID NO: 752 - RNA, 18 nt, Homo sapiens
gaggcugaaggaagaugg

SEQ ID NO: 753 - RNA, 18 nt, Homo sapiens
ccaucuuccuucagccuc

SEQ ID NO: 754 - RNA, 22 nt, Homo sapiens
gucacugaugucuguagcugag

SEQ ID NO: 755 - RNA, 22 nt, Homo sapiens
cucagcuacagacaucagugac

SEQ ID NO: 756 - RNA, 22 nt, Homo sapiens
accugucuguggaaaggagcua

SEQ ID NO: 757 - RNA, 22 nt, Homo sapiens
uagcuccuuuccacagacaggu

SEQ ID NO: 758 - RNA, 22 nt, Homo sapiens
agaguuaacucaaaauggacua

SEQ ID NO: 759 - RNA, 22 nt, Homo sapiens
uaguccauuuugaguuaacucu

SEQ ID NO: 760 - RNA, 22 nt, Homo sapiens
uguugggauucagcaggaccau

SEQ ID NO: 761 - RNA, 22 nt, Homo sapiens
augguccugcugaaucccaaca

SEQ ID NO: 762 - RNA, 17 nt, Homo sapiens
gaagauggacguacuuu

SEQ ID NO: 763 - RNA, 17 nt, Homo sapiens
aaaguacguccaucuuc

SEQ ID NO: 764 - RNA, 21 nt, Homo sapiens
ucugaauagagucugaagagu

SEQ ID NO: 765 - RNA, 21 nt, Homo sapiens
acucuucagacucuauucaga

SEQ ID NO: 766 - RNA, 22 nt, Homo sapiens
caaggagacgggaacauggagc

SEQ ID NO: 767 - RNA, 22 nt, Homo sapiens
gcuccauguucccgucuccuug

SEQ ID NO: 768 - RNA, 20 nt, Homo sapiens
aaaagcugggcugagaggcg

SEQ ID NO: 769 - RNA, 20 nt, Homo sapiens
cgccucucagcccagcuuuu

SEQ ID NO: 770 - RNA, 18 nt, Homo sapiens
aggcuggagugagcggag

SEQ ID NO: 771 - RNA, 18 nt, Homo sapiens
cuccgcucacuccagccu

SEQ ID NO: 772 - RNA, 22 nt, Homo sapiens
gcgacucugaaaacuagaaggu

SEQ ID NO: 773 - RNA, 22 nt, Homo sapiens
accuucuaguuuucagagucgc

SEQ ID NO: 774 - RNA, 20 nt, Homo sapiens
aaagacucugcaagaugccu

SEQ ID NO: 775 - RNA, 20 nt, Homo sapiens
aggcaucuugcagagucuuu

SEQ ID NO: 776 - RNA, 21 nt, Homo sapiens
acaggagugggggugggacau

SEQ ID NO: 777 - RNA, 21 nt, Homo sapiens
augucccacccccacuccugu

SEQ ID NO: 778 - RNA, 21 nt, Homo sapiens
cgucccaccccccacuccugu

SEQ ID NO: 779 - RNA, 21 nt, Homo sapiens
acaggaguggggggugggacg

SEQ ID NO: 780 - RNA, 18 nt, Homo sapiens
aggagaaguaaaguagaa

SEQ ID NO: 781 - RNA, 18 nt, Homo sapiens
uucuacuuuacuucuccu

SEQ ID NO: 782 - RNA, 22 nt, Homo sapiens
auggccagagcucacacagagg

SEQ ID NO: 783 - RNA, 22 nt, Homo sapiens
ccucugugugagcucuggccau

SEQ ID NO: 784 - RNA, 21 nt, Homo sapiens
ugggcucaggguacaaagguu

SEQ ID NO: 785 - RNA, 21 nt, Homo sapiens
aaccuuuguacccugagccca

SEQ ID NO: 786 - RNA, 21 nt, Homo sapiens
cacaggcuuagaaaagacagu

SEQ ID NO: 787 - RNA, 21 nt, Homo sapiens
acugucuuuucuaagccugug

SEQ ID NO: 788 - RNA, 22 nt, Homo sapiens
gugacugauaccuuggaggcau

SEQ ID NO: 789 - RNA, 22 nt, Homo sapiens
augccuccaagguaucagucac

SEQ ID NO: 790 - RNA, 22 nt, Homo sapiens
ugucguggggcuugcuggcuug

SEQ ID NO: 791 - RNA, 22 nt, Homo sapiens
caagccagcaagccccacgaca

SEQ ID NO: 792 - RNA, 17 nt, Homo sapiens
acagggaggagauugua

SEQ ID NO: 793 - RNA, 17 nt, Homo sapiens
uacaaucuccucccugu

SEQ ID NO: 794 - RNA, 17 nt, Homo sapiens
gccggacaagagggagg

SEQ ID NO: 795 - RNA, 17 nt, Homo sapiens
ccucccucuuguccggc

SEQ ID NO: 796 - RNA, 17 nt, Homo sapiens
uuggaggcguggguuuu

SEQ ID NO: 797 - RNA, 17 nt, Homo sapiens
aaaacccacgccuccaa

SEQ ID NO: 798 - RNA, 18 nt, Homo sapiens
cucgaguuggaagaggcg

SEQ ID NO: 799 - RNA, 18 nt, Homo sapiens
cgccucuuccaacucgag

SEQ ID NO: 800 - RNA, 21 nt, Homo sapiens
cacggcaaaagaaacaaucca

SEQ ID NO: 801 - RNA, 21 nt, Homo sapiens
uggauuguuucuuuugccgug

SEQ ID NO: 802 - RNA, 22 nt, Homo sapiens
agauuguuucuuuugccgugca

SEQ ID NO: 803 - RNA, 22 nt, Homo sapiens
ugcacggcaaaagaaacaaucu

SEQ ID NO: 804 - RNA, 17 nt, Homo sapiens
ggugggggcuguuguuu

SEQ ID NO: 805 - RNA, 17 nt, Homo sapiens
aaacaacagcccccacc

SEQ ID NO: 806 - RNA, 20 nt, Homo sapiens
ggcuccuuggucuaggggua

SEQ ID NO: 807 - RNA, 20 nt, Homo sapiens
uaccccuagaccaaggagcc

SEQ ID NO: 808 - RNA, 22 nt, Homo sapiens
cgucccggggcugcgcgaggca

SEQ ID NO: 809 - RNA, 22 nt, Homo sapiens
ugccucgcgcagccccgggacg

SEQ ID NO: 810 - RNA, 22 nt, Homo sapiens
uggggauuuggagaagugguga

SEQ ID NO: 811 - RNA, 22 nt, Homo sapiens
ucaccacuucuccaaaucccca

SEQ ID NO: 812 - RNA, 17 nt, Homo sapiens
ugguagagcugaggaca

SEQ ID NO: 813 - RNA, 17 nt, Homo sapiens
uguccucagcucuacca

SEQ ID NO: 814 - RNA, 23 nt, Homo sapiens
uugaauucuuggccuuaagugau

SEQ ID NO: 815 - RNA, 23 nt, Homo sapiens
aucacuuaaggccaagaauucaa

SEQ ID NO: 816 - RNA, 20 nt, Homo sapiens
gagcuuggucuguagcgguu

SEQ ID NO: 817 - RNA, 20 nt, Homo sapiens
aaccgcuacagaccaagcuc

SEQ ID NO: 818 - RNA, 20 nt, Homo sapiens
ggauccgagucacggcacca

SEQ ID NO: 819 - RNA, 20 nt, Homo sapiens
uggugccgugacucggaucc

SEQ ID NO: 820 - RNA, 17 nt, Homo sapiens
aggguguguguguuuuu

SEQ ID NO: 821 - RNA, 17 nt, Homo sapiens
aaaaacacacacacccu

SEQ ID NO: 822 - RNA, 17 nt, Homo sapiens
ccugguggcuuccuuuu

SEQ ID NO: 823 - RNA, 17 nt, Homo sapiens
aaaaggaagccaccagg

SEQ ID NO: 824 - RNA, 22 nt, Homo sapiens
ucacaagguauugacuggcgua

SEQ ID NO: 825 - RNA, 22 nt, Homo sapiens
uacgccagucaauaccuuguga

SEQ ID NO: 826 - RNA, 19 nt, Homo sapiens
agagguagguguggaagaa

SEQ ID NO: 827 - RNA, 19 nt, Homo sapiens
uucuuccacaccuaccucu

SEQ ID NO: 828 - RNA, 22 nt, Homo sapiens
ccaggaggcggaggagguggag

SEQ ID NO: 829 - RNA, 22 nt, Homo sapiens
cuccaccuccuccgccuccugg

SEQ ID NO: 830 - RNA, 22 nt, Homo sapiens
auagugguugugaauuuaccuu

SEQ ID NO: 831 - RNA, 22 nt, Homo sapiens
aagguaaauucacaaccacuau

SEQ ID NO: 832 - RNA, 23 nt, Homo sapiens
gauugagacuaguagggcuaggc

SEQ ID NO: 833 - RNA, 23 nt, Homo sapiens
gccuagcccuacuagucucaauc

SEQ ID NO: 834 - RNA, 23 nt, Homo sapiens
ugacacggaggguggcuugggaa

SEQ ID NO: 835 - RNA, 23 nt, Homo sapiens
uucccaagccacccuccguguca

SEQ ID NO: 836 - RNA, 17 nt, Homo sapiens
gagacugggguggggcc

SEQ ID NO: 837 - RNA, 17 nt, Homo sapiens
ggccccaccccagucuc

SEQ ID NO: 838 - RNA, 21 nt, Homo sapiens
aagguuuggauagaugcaaua

SEQ ID NO: 839 - RNA, 21 nt, Homo sapiens
uauugcaucuauccaaaccuu

SEQ ID NO: 840 - RNA, 22 nt, Homo sapiens
cucaaguagucugaccagggga

SEQ ID NO: 841 - RNA, 22 nt, Homo sapiens
uccccuggucagacuacuugag

SEQ ID NO: 842 - RNA, 18 nt, Homo sapiens
gggugcgggccggcgggg

SEQ ID NO: 843 - RNA, 18 nt, Homo sapiens
ccccgccggcccgcaccc

SEQ ID NO: 844 - RNA, 18 nt, Homo sapiens
agagcagaaggaugagau

SEQ ID NO: 845 - RNA, 18 nt, Homo sapiens
aucucauccuucugcucu

SEQ ID NO: 846 - RNA, 21 nt, Homo sapiens
uggcaaacguggaagccgaga

SEQ ID NO: 847 - RNA, 21 nt, Homo sapiens
ucucggcuuccacguuugcca

SEQ ID NO: 848 - RNA, 18 nt, Homo sapiens
ggugggggguguuguuuu

SEQ ID NO: 849 - RNA, 18 nt, Homo sapiens
aaaacaacaccccccacc

SEQ ID NO: 850 - RNA, 22 nt, Homo sapiens
cuagugcucuccguuacaagua

SEQ ID NO: 851 - RNA, 22 nt, Homo sapiens
uacuuguaacggagagcacuag

SEQ ID NO: 852 - RNA, 22 nt, Homo sapiens
caagggaccaagcauucauuau

SEQ ID NO: 853 - RNA, 22 nt, Homo sapiens
auaaugaaugcuuggucccuug

SEQ ID NO: 854 - RNA, 22 nt, Homo sapiens
caggaaggauuuagggacaggc

SEQ ID NO: 855 - RNA, 22 nt, Homo sapiens
gccugucccuaaauccuuccug

SEQ ID NO: 856 - RNA, 22 nt, Homo sapiens
cuauuaaggacauuugugauuc

SEQ ID NO: 857 - RNA, 22 nt, Homo sapiens
gaaucacaaauguccuuaauag

SEQ ID NO: 858 - RNA, 22 nt, Homo sapiens
auuaaggacauuugugauugau

SEQ ID NO: 859 - RNA, 22 nt, Homo sapiens
aucaaucacaaauguccuuaau

SEQ ID NO: 860 - RNA, 17 nt, Homo sapiens
gaggcugagcugaggag

SEQ ID NO: 861 - RNA, 17 nt, Homo sapiens
cuccucagcucagccuc

SEQ ID NO: 862 - RNA, 22 nt, Homo sapiens
cgcgcggccgugcucggagcag

SEQ ID NO: 863 - RNA, 22 nt, Homo sapiens
cugcuccgagcacggccgcgcg

SEQ ID NO: 864 - RNA, 21 nt, Homo sapiens
agccaaguggaaguuacuuua

SEQ ID NO: 865 - RNA, 21 nt, Homo sapiens
uaaaguaacuuccacuuggcu

SEQ ID NO: 866 - RNA, 17 nt, Homo sapiens
ggagugggcuggugguu

SEQ ID NO: 867 - RNA, 17 nt, Homo sapiens
aaccaccagcccacucc

SEQ ID NO: 868 - RNA, 22 nt, Homo sapiens
uuucuauuucucaguggggcuc

SEQ ID NO: 869 - RNA, 22 nt, Homo sapiens
gagccccacugagaaauagaaa

SEQ ID NO: 870 - RNA, 22 nt, Homo sapiens
aacccagugggcuauggaaaug

SEQ ID NO: 871 - RNA, 22 nt, Homo sapiens
cauuuccauagcccacuggguu

SEQ ID NO: 872 - RNA, 17 nt, Homo sapiens
gggguggucuguuguug

SEQ ID NO: 873 - RNA, 17 nt, Homo sapiens
caacaacagaccacccc

SEQ ID NO: 874 - RNA, 20 nt, Homo sapiens
aaaaggcgggagaagcccca

SEQ ID NO: 875 - RNA, 20 nt, Homo sapiens
uggggcuucucccgccuuuu

SEQ ID NO: 876 - RNA, 20 nt, Homo sapiens
uaacggccgcgguacccuaa

SEQ ID NO: 877 - RNA, 20 nt, Homo sapiens
uuaggguaccgcggccguua

SEQ ID NO: 878 - RNA, 17 nt, Homo sapiens
gcugggcgaggcuggca

SEQ ID NO: 879 - RNA, 17 nt, Homo sapiens
ugccagccucgcccagc

SEQ ID NO: 880 - RNA, 19 nt, Homo sapiens
agagcuggcugaagggcag

SEQ ID NO: 881 - RNA, 19 nt, Homo sapiens
cugcccuucagccagcucu

SEQ ID NO: 882 - RNA, 18 nt, Homo sapiens
agggggcgggcuccggcg

SEQ ID NO: 883 - RNA, 18 nt, Homo sapiens
cgccggagcccgcccccu

SEQ ID NO: 884 - RNA, 22 nt, Homo sapiens
ucugguaagagauuugggcaua

SEQ ID NO: 885 - RNA, 22 nt, Homo sapiens
uaugcccaaaucucuuaccaga

SEQ ID NO: 886 - RNA, 22 nt, Homo sapiens
aauguggacuggugugaccaaa

SEQ ID NO: 887 - RNA, 22 nt, Homo sapiens
uuuggucacaccaguccacauu

SEQ ID NO: 888 - RNA, 17 nt, Homo sapiens
ggggcugggcgcgcgcc

SEQ ID NO: 889 - RNA, 17 nt, Homo sapiens
ggcgcgcgcccagcccc

SEQ ID NO: 890 - RNA, 21 nt, Homo sapiens
agaaggccuuuccaucucugu

SEQ ID NO: 891 - RNA, 21 nt, Homo sapiens
acagagauggaaaggccuucu

SEQ ID NO: 892 - RNA, 22 nt, Homo sapiens
ccagacuguggcugaccagagg

SEQ ID NO: 893 - RNA, 22 nt, Homo sapiens
ccucuggucagccacagucugg

SEQ ID NO: 894 - RNA, 21 nt, Homo sapiens
aauguaaacaggcuuuuugcu

SEQ ID NO: 895 - RNA, 21 nt, Homo sapiens
agcaaaaagccuguuuacauu

SEQ ID NO: 896 - RNA, 22 nt, Homo sapiens
gaggaaacugaagcugagaggg

SEQ ID NO: 897 - RNA, 22 nt, Homo sapiens
cccucucagcuucaguuuccuc

SEQ ID NO: 898 - RNA, 17 nt, Homo sapiens
cuccgggacggcugggc

SEQ ID NO: 899 - RNA, 17 nt, Homo sapiens
gcccagccgucccggag

SEQ ID NO: 900 - RNA, 22 nt, Homo sapiens
ugggcuggcagggcaagugcug

SEQ ID NO: 901 - RNA, 22 nt, Homo sapiens
cagcacuugcccugccagccca

SEQ ID NO: 902 - RNA, 17 nt, Homo sapiens
aagacugagaggaggga

SEQ ID NO: 903 - RNA, 17 nt, Homo sapiens
ucccuccucucagucuu

SEQ ID NO: 904 - RNA, 17 nt, Homo sapiens
ugagguaguaguuucuu

SEQ ID NO: 905 - RNA, 17 nt, Homo sapiens
aagaaacuacuaccuca

SEQ ID NO: 906 - RNA, 21 nt, Homo sapiens
uaugugaccucggaugaauca

SEQ ID NO: 907 - RNA, 21 nt, Homo sapiens
ugauucauccgaggucacaua

SEQ ID NO: 908 - RNA, 22 nt, Homo sapiens
gcugaugaugauggugcugaag

SEQ ID NO: 909 - RNA, 22 nt, Homo sapiens
cuucagcaccaucaucaucagc

SEQ ID NO: 910 - RNA, 22 nt, Homo sapiens
uuuaagcaggaaauagaauuua

SEQ ID NO: 911 - RNA, 22 nt, Homo sapiens
uaaauucuauuuccugcuuaaa

SEQ ID NO: 912 - RNA, 22 nt, Homo sapiens
ugugacaauagagaugaacaug

SEQ ID NO: 913 - RNA, 22 nt, Homo sapiens
cauguucaucucuauugucaca

SEQ ID NO: 914 - RNA, 18 nt, Homo sapiens
aggcugggcugggacgga

SEQ ID NO: 915 - RNA, 18 nt, Homo sapiens
uccgucccagcccagccu

SEQ ID NO: 916 - RNA, 20 nt, Homo sapiens
aaauggguggucugaggcaa

SEQ ID NO: 917 - RNA, 20 nt, Homo sapiens
uugccucagaccacccauuu

SEQ ID NO: 918 - RNA, 20 nt, Homo sapiens
cuggguugggcugggcuggg

SEQ ID NO: 919 - RNA, 20 nt, Homo sapiens
cccagcccagcccaacccag

SEQ ID NO: 920 - RNA, 17 nt, Homo sapiens
gcggggcugggcgcgcg

SEQ ID NO: 921 - RNA, 17 nt, Homo sapiens
cgcgcgcccagccccgc

SEQ ID NO: 922 - RNA, 22 nt, Homo sapiens
acuaaaggauauagaagguuuu

SEQ ID NO: 923 - RNA, 22 nt, Homo sapiens
aaaaccuucuauauccuuuagu

SEQ ID NO: 924 - RNA, 22 nt, Homo sapiens
ugagggaguaggauguaugguu

SEQ ID NO: 925 - RNA, 22 nt, Homo sapiens
aaccauacauccuacucccuca

SEQ ID NO: 926 - RNA, 22 nt, Homo sapiens
gaagaacuguugcauuugcccu

SEQ ID NO: 927 - RNA, 22 nt, Homo sapiens
agggcaaaugcaacaguucuuc

SEQ ID NO: 928 - RNA, 22 nt, Homo sapiens
cagggccucacuguaucgccca

SEQ ID NO: 929 - RNA, 22 nt, Homo sapiens
ugggcgauacagugaggcccug

SEQ ID NO: 930 - RNA, 22 nt, Homo sapiens
agacugacggcuggaggcccau

SEQ ID NO: 931 - RNA, 22 nt, Homo sapiens
augggccuccagccgucagucu

SEQ ID NO: 932 - RNA, 18 nt, Homo sapiens
acaggcaggauuggggaa

SEQ ID NO: 933 - RNA, 18 nt, Homo sapiens
uuccccaauccugccugu

SEQ ID NO: 934 - RNA, 22 nt, Homo sapiens
aggacuggacucccggcagccc

SEQ ID NO: 935 - RNA, 22 nt, Homo sapiens
gggcugccgggaguccaguccu

SEQ ID NO: 936 - RNA, 17 nt, Homo sapiens
gggagaagggucggggc

SEQ ID NO: 937 - RNA, 17 nt, Homo sapiens
gccccgacccuucuccc

SEQ ID NO: 938 - RNA, 25 nt, Homo sapiens
aaauaugaugaaacucacagcugag

SEQ ID NO: 939 - RNA, 25 nt, Homo sapiens
cucagcugugaguuucaucauauuu

SEQ ID NO: 940 - RNA, 26 nt, Homo sapiens
gcucagggaugauaacugugcugaga

SEQ ID NO: 941 - RNA, 26 nt, Homo sapiens
ucucagcacaguuaucaucccugagc

SEQ ID NO: 942 - RNA, 18 nt, Homo sapiens
cagcagugcgcagggcug

SEQ ID NO: 943 - RNA, 18 nt, Homo sapiens
cagcccugcgcacugcug

SEQ ID NO: 944 - RNA, 22 nt, Homo sapiens
gcuaaggaaguccugugcucag

SEQ ID NO: 945 - RNA, 22 nt, Homo sapiens
cugagcacaggacuuccuuagc

SEQ ID NO: 946 - RNA, 21 nt, Homo sapiens
ugacucugccuguaggccggu

SEQ ID NO: 947 - RNA, 21 nt, Homo sapiens
accggccuacaggcagaguca

SEQ ID NO: 948 - RNA, 21 nt, Homo sapiens
gaccgagagggccucggcugu

SEQ ID NO: 949 - RNA, 21 nt, Homo sapiens
acagccgaggcccucucgguc

SEQ ID NO: 950 - RNA, 21 nt, Homo sapiens
ggggggaugugcaugcugguu

SEQ ID NO: 951 - RNA, 21 nt, Homo sapiens
aaccagcaugcacaucccccc

SEQ ID NO: 952 - RNA, 22 nt, Homo sapiens
uggucugcaaagagaugacugu

SEQ ID NO: 953 - RNA, 22 nt, Homo sapiens
acagucaucucuuugcagacca

SEQ ID NO: 954 - RNA, 22 nt, Homo sapiens
ucauuauauguaugaucuggac

SEQ ID NO: 955 - RNA, 22 nt, Homo sapiens
guccagaucauacauauaauga

SEQ ID NO: 956 - RNA, 18 nt, Homo sapiens
cccagcaggacgggagcg

SEQ ID NO: 957 - RNA, 18 nt, Homo sapiens
cgcucccguccugcuggg

SEQ ID NO: 958 - RNA, 17 nt, Homo sapiens
auggagaaggcuucuga

SEQ ID NO: 959 - RNA, 17 nt, Homo sapiens
ucagaagccuucuccau

SEQ ID NO: 960 - RNA, 17 nt, Homo sapiens
ccccggggagcccggcg

SEQ ID NO: 961 - RNA, 17 nt, Homo sapiens
cgccgggcuccccgggg

SEQ ID NO: 962 - RNA, 22 nt, Homo sapiens
uggaaggagguugccggacgcu

SEQ ID NO: 963 - RNA, 22 nt, Homo sapiens
agcguccggcaaccuccuucca

SEQ ID NO: 964 - RNA, 17 nt, Homo sapiens
ggauggaggaggggucu

SEQ ID NO: 965 - RNA, 17 nt, Homo sapiens
agaccccuccuccaucc

SEQ ID NO: 966 - RNA, 17 nt, Homo sapiens
guggaccuggcugggac

SEQ ID NO: 967 - RNA, 17 nt, Homo sapiens
gucccagccagguccac

SEQ ID NO: 968 - RNA, 21 nt, Homo sapiens
ucgugcauauaucuaccacau

SEQ ID NO: 969 - RNA, 21 nt, Homo sapiens
augugguagauauaugcacga

SEQ ID NO: 970 - RNA, 21 nt, Homo sapiens
ugugguagauauaugcacgau

SEQ ID NO: 971 - RNA, 21 nt, Homo sapiens
aucgugcauauaucuaccaca

SEQ ID NO: 972 - RNA, 22 nt, Homo sapiens
ugagccgagcugagcuuagcug

SEQ ID NO: 973 - RNA, 22 nt, Homo sapiens
cagcuaagcucagcucggcuca

SEQ ID NO: 974 - RNA, 22 nt, Homo sapiens
gagcuuggaugagcugggcuga

SEQ ID NO: 975 - RNA, 22 nt, Homo sapiens
ucagcccagcucauccaagcuc

SEQ ID NO: 976 - RNA, 22 nt, Homo sapiens
gcugaacugggcugagcugggc

SEQ ID NO: 977 - RNA, 22 nt, Homo sapiens
gcccagcucagcccaguucagc

SEQ ID NO: 978 - RNA, 21 nt, Homo sapiens
uuaguccugccuguagguuua

SEQ ID NO: 979 - RNA, 21 nt, Homo sapiens
uaaaccuacaggcaggacuaa

SEQ ID NO: 980 - RNA, 20 nt, Homo sapiens
uugggcugggcuggguuggg

SEQ ID NO: 981 - RNA, 20 nt, Homo sapiens
cccaacccagcccagcccaa

SEQ ID NO: 982 - RNA, 20 nt, Homo sapiens
uaggaugggggugagaggug

SEQ ID NO: 983 - RNA, 20 nt, Homo sapiens
caccucucacccccauccua

SEQ ID NO: 984 - RNA, 22 nt, Homo sapiens
aaaaguaauuguggauuuugcu

SEQ ID NO: 985 - RNA, 22 nt, Homo sapiens
agcaaaauccacaauuacuuuu

SEQ ID NO: 986 - RNA, 22 nt, Homo sapiens
caaaaaccggcaauuacuuuug

SEQ ID NO: 987 - RNA, 22 nt, Homo sapiens
caaaaguaauugccgguuuuug

SEQ ID NO: 988 - RNA, 22 nt, Homo sapiens
gaaaacgacaaugacuuuugca

SEQ ID NO: 989 - RNA, 22 nt, Homo sapiens
ugcaaaagucauugucguuuuc

SEQ ID NO: 990 - RNA, 21 nt, Homo sapiens
caaaaacugcaauuacuuuca

SEQ ID NO: 991 - RNA, 21 nt, Homo sapiens
ugaaaguaauugcaguuuuug

SEQ ID NO: 992 - RNA, 21 nt, Homo sapiens
aaagguaauugugguuucugc

SEQ ID NO: 993 - RNA, 21 nt, Homo sapiens
gcagaaaccacaauuaccuuu

SEQ ID NO: 994 - RNA, 22 nt, Homo sapiens
caaaaacugcaguuacuuuugc

SEQ ID NO: 995 - RNA, 22 nt, Homo sapiens
gcaaaaguaacugcaguuuuug

SEQ ID NO: 996 - RNA, 20 nt, Homo sapiens
aaaagugauugcaguguuug

SEQ ID NO: 997 - RNA, 20 nt, Homo sapiens
caaacacugcaaucacuuuu

SEQ ID NO: 998 - RNA, 22 nt, Homo sapiens
aaagguaauugcaguuuuuccc

SEQ ID NO: 999 - RNA, 22 nt, Homo sapiens
gggaaaaacugcaauuaccuuu

SEQ ID NO: 1000 - RNA, 21 nt, Homo sapiens
uaaaaacugcaauuacuuuua

SEQ ID NO: 1001 - RNA, 21 nt, Homo sapiens
uaaaaguaauugcaguuuuua

SEQ ID NO: 1002 - RNA, 23 nt, Homo sapiens
ugcaaaaguaauugcaguuuuug

SEQ ID NO: 1003 - RNA, 23 nt, Homo sapiens
caaaaacugcaauuacuuuugca

SEQ ID NO: 1004 - RNA, 21 nt, Homo sapiens
aaaaguaacugcgguuuuuga

SEQ ID NO: 1005 - RNA, 21 nt, Homo sapiens
ucaaaaaccgcaguuacuuuu

SEQ ID NO: 1006 - RNA, 22 nt, Homo sapiens
aacggcaaugacuuuuguacca

SEQ ID NO: 1007 - RNA, 22 nt, Homo sapiens
ugguacaaaagucauugccguu

SEQ ID NO: 1008 - RNA, 22 nt, Homo sapiens
caaaaacugcaguuacuuuugu

SEQ ID NO: 1009 - RNA, 22 nt, Homo sapiens
acaaaaguaacugcaguuuuug

SEQ ID NO: 1010 - RNA, 22 nt, Homo sapiens
aaaaguaauugcgguuuuugcc

SEQ ID NO: 1011 - RNA, 22 nt, Homo sapiens
ggcaaaaaccgcaauuacuuuu

SEQ ID NO: 1012 - RNA, 20 nt, Homo sapiens
aaaaggcauugugguuuuug

SEQ ID NO: 1013 - RNA, 20 nt, Homo sapiens
caaaaaccacaaugccuuuu

SEQ ID NO: 1014 - RNA, 23 nt, Homo sapiens
cggcccgggcugcugcuguuccu

SEQ ID NO: 1015 - RNA, 23 nt, Homo sapiens
aggaacagcagcagcccgggccg

SEQ ID NO: 1016 - RNA, 20 nt, Homo sapiens
agagguauagggcaugggaa

SEQ ID NO: 1017 - RNA, 20 nt, Homo sapiens
uucccaugcccuauaccucu

SEQ ID NO: 1018 - RNA, 22 nt, Homo sapiens
uuccuaugcauauacuucuuug

SEQ ID NO: 1019 - RNA, 22 nt, Homo sapiens
caaagaaguauaugcauaggaa

SEQ ID NO: 1020 - RNA, 22 nt, Homo sapiens
aucauagaggaaaauccauguu

SEQ ID NO: 1021 - RNA, 22 nt, Homo sapiens
aacauggauuuuccucuaugau

SEQ ID NO: 1022 - RNA, 22 nt, Homo sapiens
cguggauauuccuucuauguuu

SEQ ID NO: 1023 - RNA, 22 nt, Homo sapiens
aaacauagaaggaauauccacg

SEQ ID NO: 1024 - RNA, 22 nt, Homo sapiens
ugaguauuacauggccaaucuc

SEQ ID NO: 1025 - RNA, 22 nt, Homo sapiens
gagauuggccauguaauacuca

SEQ ID NO: 1026 - RNA, 21 nt, Homo sapiens
cuuccgccccgccgggcgucg

SEQ ID NO: 1027 - RNA, 21 nt, Homo sapiens
cgacgcccggcggggcggaag

SEQ ID NO: 1028 - RNA, 22 nt, Homo sapiens
uagcuuaucagacugauguuga

SEQ ID NO: 1029 - RNA, 22 nt, Homo sapiens
ucaacaucagucugauaagcua

SEQ ID NO: 1030 - RNA, 22 nt, Homo sapiens
cacuagauugugagcuccugga

SEQ ID NO: 1031 - RNA, 22 nt, Homo sapiens
uccaggagcucacaaucuagug

SEQ ID NO: 1032 - RNA, 22 nt, Homo sapiens
aaggagcucacagucuauugag

SEQ ID NO: 1033 - RNA, 22 nt, Homo sapiens
cucaauagacugugagcuccuu

SEQ ID NO: 1034 - RNA, 22 nt, Homo sapiens
uacgucaucguugucaucguca

SEQ ID NO: 1035 - RNA, 22 nt, Homo sapiens
ugacgaugacaacgaugacgua

SEQ ID NO: 1036 - RNA, 22 nt, Homo sapiens
cacgcucaugcacacacccaca

SEQ ID NO: 1037 - RNA, 22 nt, Homo sapiens
ugugggugugugcaugagcgug

SEQ ID NO: 1038 - RNA, 21 nt, Homo sapiens
caacaccagucgaugggcugu

SEQ ID NO: 1039 - RNA, 21 nt, Homo sapiens
acagcccaucgacugguguug

SEQ ID NO: 1040 - RNA, 22 nt, Homo sapiens
uucaccaccuucuccacccagc

SEQ ID NO: 1041 - RNA, 22 nt, Homo sapiens
gcuggguggagaagguggugaa

SEQ ID NO: 1042 - RNA, 23 nt, Homo sapiens
cggguagagagggcagugggagg

SEQ ID NO: 1043 - RNA, 23 nt, Homo sapiens
ccucccacugcccucucuacccg

SEQ ID NO: 1044 - RNA, 18 nt, Homo sapiens
aauccuugcuaccugggu

SEQ ID NO: 1045 - RNA, 18 nt, Homo sapiens
acccagguagcaaggauu

SEQ ID NO: 1046 - RNA, 22 nt, Homo sapiens
caauuuagugugugugauauuu

SEQ ID NO: 1047 - RNA, 22 nt, Homo sapiens
aaauaucacacacacuaaauug

SEQ ID NO: 1048 - RNA, 22 nt, Homo sapiens
uauugcacauuacuaaguugca

SEQ ID NO: 1049 - RNA, 22 nt, Homo sapiens
ugcaacuuaguaaugugcaaua

SEQ ID NO: 1050 - RNA, 22 nt, Homo sapiens
ccuauucuugauuacuuguuuc

SEQ ID NO: 1051 - RNA, 22 nt, Homo sapiens
gaaacaaguaaucaagaauagg

SEQ ID NO: 1052 - RNA, 22 nt, Homo sapiens
uucaaguaauccaggauaggcu

SEQ ID NO: 1053 - RNA, 22 nt, Homo sapiens
agccuauccuggauuacuugaa

SEQ ID NO: 1054 - RNA, 23 nt, Homo sapiens
ccaguuaccgcuuccgcuaccgc

SEQ ID NO: 1055 - RNA, 23 nt, Homo sapiens
gcgguagcggaagcgguaacugg

SEQ ID NO: 1056 - RNA, 21 nt, Homo sapiens
gauuucaguggagugaaguuc

SEQ ID NO: 1057 - RNA, 21 nt, Homo sapiens
gaacuucacuccacugaaauc

SEQ ID NO: 1058 - RNA, 22 nt, Homo sapiens
uccuucauuccaccggagucug

SEQ ID NO: 1059 - RNA, 22 nt, Homo sapiens
cagacuccgguggaaugaagga

SEQ ID NO: 1060 - RNA, 23 nt, Homo sapiens
aaaauggugcccuagugacuaca

SEQ ID NO: 1061 - RNA, 23 nt, Homo sapiens
uguagucacuagggcaccauuuu

SEQ ID NO: 1062 - RNA, 21 nt, Homo sapiens
caagucacuagugguuccguu

SEQ ID NO: 1063 - RNA, 21 nt, Homo sapiens
aacggaaccacuagugacuug

SEQ ID NO: 1064 - RNA, 22 nt, Homo sapiens
ccaguauuaacugugcugcuga

SEQ ID NO: 1065 - RNA, 22 nt, Homo sapiens
ucagcagcacaguuaauacugg

SEQ ID NO: 1066 - RNA, 23 nt, Homo sapiens
ucccccaggugugauucugauuu

SEQ ID NO: 1067 - RNA, 23 nt, Homo sapiens
aaaucagaaucacaccuggggga

SEQ ID NO: 1068 - RNA, 22 nt, Homo sapiens
aaaagcuggguugagagggcga

SEQ ID NO: 1069 - RNA, 22 nt, Homo sapiens
ucgcccucucaacccagcuuuu

SEQ ID NO: 1070 - RNA, 22 nt, Homo sapiens
uggacggagaacugauaagggu

SEQ ID NO: 1071 - RNA, 22 nt, Homo sapiens
acccuuaucaguucuccgucca

SEQ ID NO: 1072 - RNA, 22 nt, Homo sapiens
uggugggccgcagaacaugugc

SEQ ID NO: 1073 - RNA, 22 nt, Homo sapiens
gcacauguucugcggcccacca

SEQ ID NO: 1074 - RNA, 22 nt, Homo sapiens
agugccugcuaugugccaggca

SEQ ID NO: 1075 - RNA, 22 nt, Homo sapiens
ugccuggcacauagcaggcacu

SEQ ID NO: 1076 - RNA, 22 nt, Homo sapiens
cuuggcaccuagcaagcacuca

SEQ ID NO: 1077 - RNA, 22 nt, Homo sapiens
ugagugcuugcuaggugccaag

SEQ ID NO: 1078 - RNA, 23 nt, Homo sapiens
uuauugcuuaagaauacgcguag

SEQ ID NO: 1079 - RNA, 23 nt, Homo sapiens
cuacgcguauucuuaagcaauaa

SEQ ID NO: 1080 - RNA, 22 nt, Homo sapiens
uugcauagucacaaaagugauc

SEQ ID NO: 1081 - RNA, 22 nt, Homo sapiens
gaucacuuuugugacuaugcaa

SEQ ID NO: 1082 - RNA, 22 nt, Homo sapiens
gugaauuaccgaagggccauaa

SEQ ID NO: 1083 - RNA, 22 nt, Homo sapiens
uuauggcccuucgguaauucac

SEQ ID NO: 1084 - RNA, 22 nt, Homo sapiens
uauggcacugguagaauucacu

SEQ ID NO: 1085 - RNA, 22 nt, Homo sapiens
agugaauucuaccagugccaua

SEQ ID NO: 1086 - RNA, 22 nt, Homo sapiens
ugauauguuugauauauuaggu

SEQ ID NO: 1087 - RNA, 22 nt, Homo sapiens
accuaauauaucaaacauauca

SEQ ID NO: 1088 - RNA, 21 nt, Homo sapiens
ugauauguuugauauuggguu

SEQ ID NO: 1089 - RNA, 21 nt, Homo sapiens
aacccaauaucaaacauauca

SEQ ID NO: 1090 - RNA, 18 nt, Homo sapiens
agcaggugcggggcggcg

SEQ ID NO: 1091 - RNA, 18 nt, Homo sapiens
cgccgccccgcaccugcu

SEQ ID NO: 1092 - RNA, 21 nt, Homo sapiens
cagugcaaguguagaugccga

SEQ ID NO: 1093 - RNA, 21 nt, Homo sapiens
ucggcaucuacacuugcacug

SEQ ID NO: 1094 - RNA, 22 nt, Homo sapiens
uauguaauaugguccacaucuu

SEQ ID NO: 1095 - RNA, 22 nt, Homo sapiens
aagauguggaccauauuacaua

SEQ ID NO: 1096 - RNA, 21 nt, Homo sapiens
aauauaacacagauggccugu

SEQ ID NO: 1097 - RNA, 21 nt, Homo sapiens
acaggccaucuguguuauauu

SEQ ID NO: 1098 - RNA, 22 nt, Homo sapiens
aucgggaaugucguguccgccc

SEQ ID NO: 1099 - RNA, 22 nt, Homo sapiens
gggcggacacgacauucccgau

SEQ ID NO: 1100 - RNA, 23 nt, Homo sapiens
aaugacacgaucacucccguuga

SEQ ID NO: 1101 - RNA, 23 nt, Homo sapiens
ucaacgggagugaucgugucauu

SEQ ID NO: 1102 - RNA, 22 nt, Homo sapiens
uacucaggagaguggcaaucac

SEQ ID NO: 1103 - RNA, 22 nt, Homo sapiens
gugauugccacucuccugagua

SEQ ID NO: 1104 - RNA, 23 nt, Homo sapiens
uggaagacuagugauuuuguugu

SEQ ID NO: 1105 - RNA, 23 nt, Homo sapiens
acaacaaaaucacuagucuucca

SEQ ID NO: 1106 - RNA, 22 nt, Homo sapiens
auaaagcuagauaaccgaaagu

SEQ ID NO: 1107 - RNA, 22 nt, Homo sapiens
acuuucgguuaucuagcuuuau

SEQ ID NO: 1108 - RNA, 23 nt, Homo sapiens
ucuuugguuaucuagcuguauga

SEQ ID NO: 1109 - RNA, 23 nt, Homo sapiens
ucauacagcuagauaaccaaaga

SEQ ID NO: 1110 - RNA, 22 nt, Homo sapiens
acaggugagguucuugggagcc

SEQ ID NO: 1111 - RNA, 22 nt, Homo sapiens
ggcucccaagaaccucaccugu

SEQ ID NO: 1112 - RNA, 24 nt, Homo sapiens
ucccugagacccuuuaaccuguga

SEQ ID NO: 1113 - RNA, 24 nt, Homo sapiens
ucacagguuaaagggucucaggga

SEQ ID NO: 1114 - RNA, 22 nt, Homo sapiens
caacaaaucccagucuaccuaa

SEQ ID NO: 1115 - RNA, 22 nt, Homo sapiens
uuagguagacugggauuuguug

SEQ ID NO: 1116 - RNA, 22 nt, Homo sapiens
cguguucacagcggaccuugau

SEQ ID NO: 1117 - RNA, 22 nt, Homo sapiens
aucaagguccgcugugaacacg

SEQ ID NO: 1118 - RNA, 20 nt, Homo sapiens
uaaggcacgcggugaaugcc

SEQ ID NO: 1119 - RNA, 20 nt, Homo sapiens
ggcauucaccgcgugccuua

SEQ ID NO: 1120 - RNA, 22 nt, Homo sapiens
aacacaccugguuaaccucuuu

SEQ ID NO: 1121 - RNA, 22 nt, Homo sapiens
aaagagguuaaccagguguguu

SEQ ID NO: 1122 - RNA, 22 nt, Homo sapiens
uaacagucuacagccauggucg

SEQ ID NO: 1123 - RNA, 22 nt, Homo sapiens
cgaccauggcuguagacuguua

SEQ ID NO: 1124 - RNA, 22 nt, Homo sapiens
accguggcuuucgauuguuacu

SEQ ID NO: 1125 - RNA, 22 nt, Homo sapiens
aguaacaaucgaaagccacggu

SEQ ID NO: 1126 - RNA, 21 nt, Homo sapiens
uaacagucuccagucacggcc

SEQ ID NO: 1127 - RNA, 21 nt, Homo sapiens
ggccgugacuggagacuguua

SEQ ID NO: 1128 - RNA, 23 nt, Homo sapiens
accuuggcucuagacugcuuacu

SEQ ID NO: 1129 - RNA, 23 nt, Homo sapiens
aguaagcagucuagagccaaggu

SEQ ID NO: 1130 - RNA, 23 nt, Homo sapiens
ucucacacagaaaucgcacccgu

SEQ ID NO: 1131 - RNA, 23 nt, Homo sapiens
acgggugcgauuucugugugaga

SEQ ID NO: 1132 - RNA, 22 nt, Homo sapiens
ugguugaccauagaacaugcgc

SEQ ID NO: 1133 - RNA, 22 nt, Homo sapiens
gcgcauguucuauggucaacca

SEQ ID NO: 1134 - RNA, 23 nt, Homo sapiens
caguaacaaagauucauccuugu

SEQ ID NO: 1135 - RNA, 23 nt, Homo sapiens
acaaggaugaaucuuuguuacug

SEQ ID NO: 1136 - RNA, 22 nt, Homo sapiens
agaguugagucuggacgucccg

SEQ ID NO: 1137 - RNA, 22 nt, Homo sapiens
cgggacguccagacucaacucu

SEQ ID NO: 1138 - RNA, 22 nt, Homo sapiens
agaauuguggcuggacaucugu

SEQ ID NO: 1139 - RNA, 22 nt, Homo sapiens
acagauguccagccacaauucu

SEQ ID NO: 1140 - RNA, 21 nt, Homo sapiens
ugauuguccaaacgcaauucu

SEQ ID NO: 1141 - RNA, 21 nt, Homo sapiens
agaauugcguuuggacaauca

SEQ ID NO: 1142 - RNA, 22 nt, Homo sapiens
uauagggauuggagccguggcg

SEQ ID NO: 1143 - RNA, 22 nt, Homo sapiens
cgccacggcuccaaucccuaua

SEQ ID NO: 1144 - RNA, 23 nt, Homo sapiens
uauggcuuuuuauuccuauguga

SEQ ID NO: 1145 - RNA, 23 nt, Homo sapiens
ucacauaggaauaaaaagccaua

SEQ ID NO: 1146 - RNA, 22 nt, Homo sapiens
auguagggcuaaaagccauggg

SEQ ID NO: 1147 - RNA, 22 nt, Homo sapiens
cccauggcuuuuagcccuacau

SEQ ID NO: 1148 - RNA, 23 nt, Homo sapiens
uauggcuuuucauuccuauguga

SEQ ID NO: 1149 - RNA, 23 nt, Homo sapiens
ucacauaggaaugaaaagccaua

SEQ ID NO: 1150 - RNA, 22 nt, Homo sapiens
aaccaucgaccguugaguggac

SEQ ID NO: 1151 - RNA, 22 nt, Homo sapiens
guccacucaacggucgaugguu

SEQ ID NO: 1152 - RNA, 22 nt, Homo sapiens
aacauucaaccugucggugagu

SEQ ID NO: 1153 - RNA, 22 nt, Homo sapiens
acucaccgacagguugaauguu

SEQ ID NO: 1154 - RNA, 25 nt, Homo sapiens
cuuccagacgcuccgccccacgucg

SEQ ID NO: 1155 - RNA, 25 nt, Homo sapiens
cgacguggggcggagcgucuggaag

SEQ ID NO: 1156 - RNA, 24 nt, Homo sapiens
aacaacaaaaucacuagucuucca

SEQ ID NO: 1157 - RNA, 24 nt, Homo sapiens
uggaagacuagugauuuuguuguu

SEQ ID NO: 1158 - RNA, 22 nt, Homo sapiens
agguagacugggauuuguuguu

SEQ ID NO: 1159 - RNA, 22 nt, Homo sapiens
aacaacaaaucccagucuaccu

SEQ ID NO: 1160 - RNA, 22 nt, Homo sapiens
aaacaccauugucacacuccac

SEQ ID NO: 1161 - RNA, 22 nt, Homo sapiens
guggagugugacaaugguguuu

SEQ ID NO: 1162 - RNA, 23 nt, Homo sapiens
uuuagugugauaauggcguuuga

SEQ ID NO: 1163 - RNA, 23 nt, Homo sapiens
ucaaacgccauuaucacacuaaa

SEQ ID NO: 1164 - RNA, 22 nt, Homo sapiens
uauggaaagacuuugccacucu

SEQ ID NO: 1165 - RNA, 22 nt, Homo sapiens
agaguggcaaagucuuuccaua

SEQ ID NO: 1166 - RNA, 21 nt, Homo sapiens
aguggcaaagucuuuccauau

SEQ ID NO: 1167 - RNA, 21 nt, Homo sapiens
auauggaaagacuuugccacu

SEQ ID NO: 1168 - RNA, 22 nt, Homo sapiens
cagcccggaucccagcccacuu

SEQ ID NO: 1169 - RNA, 22 nt, Homo sapiens
aagugggcugggauccgggcug

SEQ ID NO: 1170 - RNA, 20 nt, Homo sapiens
guggguuggggcgggcucug

SEQ ID NO: 1171 - RNA, 20 nt, Homo sapiens
cagagcccgccccaacccac

SEQ ID NO: 1172 - RNA, 23 nt, Homo sapiens
uucgggcuggccugcugcuccgg

SEQ ID NO: 1173 - RNA, 23 nt, Homo sapiens
ccggagcagcaggccagcccgaa

SEQ ID NO: 1174 - RNA, 21 nt, Homo sapiens
ugugcagcaggccaaccgaga

SEQ ID NO: 1175 - RNA, 21 nt, Homo sapiens
ucucgguuggccugcugcaca

SEQ ID NO: 1176 - RNA, 22 nt, Homo sapiens
cagggcaggaagaaguggacaa

SEQ ID NO: 1177 - RNA, 22 nt, Homo sapiens
uuguccacuucuuccugcccug

SEQ ID NO: 1178 - RNA, 22 nt, Homo sapiens
guccacuucugccugcccugcc

SEQ ID NO: 1179 - RNA, 22 nt, Homo sapiens
ggcagggcaggcagaaguggac

SEQ ID NO: 1180 - RNA, 22 nt, Homo sapiens
uuuggacagaaaacacgcaggu

SEQ ID NO: 1181 - RNA, 22 nt, Homo sapiens
accugcguguuuucuguccaaa

SEQ ID NO: 1182 - RNA, 20 nt, Homo sapiens
ccugcguguuuucuguccaa

SEQ ID NO: 1183 - RNA, 20 nt, Homo sapiens
uuggacagaaaacacgcagg

SEQ ID NO: 1184 - RNA, 22 nt, Homo sapiens
ugccgcccucucgcugcucuag

SEQ ID NO: 1185 - RNA, 22 nt, Homo sapiens
cuagagcagcgagagggcggca

SEQ ID NO: 1186 - RNA, 23 nt, Homo sapiens
gagggcagcguggguguggcgga

SEQ ID NO: 1187 - RNA, 23 nt, Homo sapiens
uccgccacacccacgcugcccuc

SEQ ID NO: 1188 - RNA, 22 nt, Homo sapiens
aggagcuagccaggcauaugca

SEQ ID NO: 1189 - RNA, 22 nt, Homo sapiens
ugcauaugccuggcuagcuccu

SEQ ID NO: 1190 - RNA, 20 nt, Homo sapiens
auaugccuggcuagcuccuc

SEQ ID NO: 1191 - RNA, 20 nt, Homo sapiens
gaggagcuagccaggcauau

SEQ ID NO: 1192 - RNA, 19 nt, Homo sapiens
cggcgcgaccggcccgggg

SEQ ID NO: 1193 - RNA, 19 nt, Homo sapiens
ccccgggccggucgcgccg

SEQ ID NO: 1194 - RNA, 21 nt, Homo sapiens
ucuugaagucagaacccgcaa

SEQ ID NO: 1195 - RNA, 21 nt, Homo sapiens
uugcggguucugacuucaaga

SEQ ID NO: 1196 - RNA, 22 nt, Homo sapiens
aacucguguucaaagccuuuag

SEQ ID NO: 1197 - RNA, 22 nt, Homo sapiens
cuaaaggcuuugaacacgaguu

SEQ ID NO: 1198 - RNA, 23 nt, Homo sapiens
ccuggacaccgcucagccggccg

SEQ ID NO: 1199 - RNA, 23 nt, Homo sapiens
cggccggcugagcgguguccagg

SEQ ID NO: 1200 - RNA, 21 nt, Homo sapiens
acucggcugcgguggacaagu

SEQ ID NO: 1201 - RNA, 21 nt, Homo sapiens
acuuguccaccgcagccgagu

SEQ ID NO: 1202 - RNA, 20 nt, Homo sapiens
ucacucucaccuugcuuugc

SEQ ID NO: 1203 - RNA, 20 nt, Homo sapiens
gcaaagcaaggugagaguga

SEQ ID NO: 1204 - RNA, 22 nt, Homo sapiens
uugcuaaguaggcugagauuga

SEQ ID NO: 1205 - RNA, 22 nt, Homo sapiens
ucaaucucagccuacuuagcaa

SEQ ID NO: 1206 - RNA, 22 nt, Homo sapiens
cacccccuguuuccuggcccac

SEQ ID NO: 1207 - RNA, 22 nt, Homo sapiens
gugggccaggaaacagggggug

SEQ ID NO: 1208 - RNA, 23 nt, Homo sapiens
ugggccagggagcagcugguggg

SEQ ID NO: 1209 - RNA, 23 nt, Homo sapiens
cccaccagcugcucccuggccca

SEQ ID NO: 1210 - RNA, 24 nt, Homo sapiens
ugcccaugccauacuuuugccuca

SEQ ID NO: 1211 - RNA, 24 nt, Homo sapiens
ugaggcaaaaguauggcaugggca

SEQ ID NO: 1212 - RNA, 22 nt, Homo sapiens
auggcaucguccccugguggcu

SEQ ID NO: 1213 - RNA, 22 nt, Homo sapiens
agccaccaggggacgaugccau

SEQ ID NO: 1214 - RNA, 22 nt, Homo sapiens
gacacaugaccauaaaugcuaa

SEQ ID NO: 1215 - RNA, 22 nt, Homo sapiens
uuagcauuuauggucauguguc

SEQ ID NO: 1216 - RNA, 23 nt, Homo sapiens
uggagagagaaaagagacagaag

SEQ ID NO: 1217 - RNA, 23 nt, Homo sapiens
cuucugucucuuuucucucucca

SEQ ID NO: 1218 - RNA, 22 nt, Homo sapiens
agacaguaguucuugccugguu

SEQ ID NO: 1219 - RNA, 22 nt, Homo sapiens
aaccaggcaagaacuacugucu

SEQ ID NO: 1220 - RNA, 19 nt, Homo sapiens
accaggcaagaaauauugu

SEQ ID NO: 1221 - RNA, 19 nt, Homo sapiens
acaauauuucuugccuggu

SEQ ID NO: 1222 - RNA, 21 nt, Homo sapiens
auugucccucucccuucccag

SEQ ID NO: 1223 - RNA, 21 nt, Homo sapiens
cugggaagggagagggacaau

SEQ ID NO: 1224 - RNA, 22 nt, Homo sapiens
acugggaagaggagcugaggga

SEQ ID NO: 1225 - RNA, 22 nt, Homo sapiens
ucccucagcuccucuucccagu

SEQ ID NO: 1226 - RNA, 23 nt, Homo sapiens
gaagauggugcugugcugaggaa

SEQ ID NO: 1227 - RNA, 23 nt, Homo sapiens
uuccucagcacagcaccaucuuc

SEQ ID NO: 1228 - RNA, 20 nt, Homo sapiens
ugugggacugcaaaugggag

SEQ ID NO: 1229 - RNA, 20 nt, Homo sapiens
cucccauuugcagucccaca

SEQ ID NO: 1230 - RNA, 21 nt, Homo sapiens
ucugaggccugccucucccca

SEQ ID NO: 1231 - RNA, 21 nt, Homo sapiens
uggggagaggcaggccucaga

SEQ ID NO: 1232 - RNA, 24 nt, Homo sapiens
ugggcgaggggugggcucucagag

SEQ ID NO: 1233 - RNA, 24 nt, Homo sapiens
cucugagagcccaccccucgccca

SEQ ID NO: 1234 - RNA, 21 nt, Homo sapiens
agguagaaugaggccugacau

SEQ ID NO: 1235 - RNA, 21 nt, Homo sapiens
augucaggccucauucuaccu

SEQ ID NO: 1236 - RNA, 19 nt, Homo sapiens
ucaggccucuuucuaccuu

SEQ ID NO: 1237 - RNA, 19 nt, Homo sapiens
aagguagaaagaggccuga

SEQ ID NO: 1238 - RNA, 20 nt, Homo sapiens
cggggugggugaggucgggc

SEQ ID NO: 1239 - RNA, 20 nt, Homo sapiens
gcccgaccucacccaccccg

SEQ ID NO: 1240 - RNA, 22 nt, Homo sapiens
guucuguuaacccauccccuca

SEQ ID NO: 1241 - RNA, 22 nt, Homo sapiens
ugaggggauggguuaacagaac

SEQ ID NO: 1242 - RNA, 22 nt, Homo sapiens
aggggacugguuaauagaacua

SEQ ID NO: 1243 - RNA, 22 nt, Homo sapiens
uaguucuauuaaccaguccccu

SEQ ID NO: 1244 - RNA, 23 nt, Homo sapiens
uggaguuaaggguugcuuggaga

SEQ ID NO: 1245 - RNA, 23 nt, Homo sapiens
ucuccaagcaacccuuaacucca

SEQ ID NO: 1246 - RNA, 22 nt, Homo sapiens
ucucugagcaaggcuuaacacc

SEQ ID NO: 1247 - RNA, 22 nt, Homo sapiens
gguguuaagccuugcucagaga

SEQ ID NO: 1248 - RNA, 22 nt, Homo sapiens
ugugggaucuggaggcaucugg

SEQ ID NO: 1249 - RNA, 22 nt, Homo sapiens
ccagaugccuccagaucccaca

SEQ ID NO: 1250 - RNA, 21 nt, Homo sapiens
acccucgucagguccccgggg

SEQ ID NO: 1251 - RNA, 21 nt, Homo sapiens
ccccggggaccugacgagggu

SEQ ID NO: 1252 - RNA, 22 nt, Homo sapiens
caccggggauggcagagggucg

SEQ ID NO: 1253 - RNA, 22 nt, Homo sapiens
cgacccucugccauccccggug

SEQ ID NO: 1254 - RNA, 23 nt, Homo sapiens
ugggcugagggcaggaggccugu

SEQ ID NO: 1255 - RNA, 23 nt, Homo sapiens
acaggccuccugcccucagccca

SEQ ID NO: 1256 - RNA, 23 nt, Homo sapiens
aauguggaaguggucugaggcau

SEQ ID NO: 1257 - RNA, 23 nt, Homo sapiens
augccucagaccacuuccacauu

SEQ ID NO: 1258 - RNA, 23 nt, Homo sapiens
gugaguguggauccuggaggaau

SEQ ID NO: 1259 - RNA, 23 nt, Homo sapiens
auuccuccaggauccacacucac

SEQ ID NO: 1260 - RNA, 22 nt, Homo sapiens
uuucuucuuagacauggcaacg

SEQ ID NO: 1261 - RNA, 22 nt, Homo sapiens
cguugccaugucuaagaagaaa

SEQ ID NO: 1262 - RNA, 22 nt, Homo sapiens
cugccaugucuaagaagaaaac

SEQ ID NO: 1263 - RNA, 22 nt, Homo sapiens
guuuucuucuuagacauggcag

SEQ ID NO: 1264 - RNA, 22 nt, Homo sapiens
uuucuucuuagacauggcagcu

SEQ ID NO: 1265 - RNA, 22 nt, Homo sapiens
agcugccaugucuaagaagaaa

SEQ ID NO: 1266 - RNA, 19 nt, Homo sapiens
uugccaugucuaagaagaa

SEQ ID NO: 1267 - RNA, 19 nt, Homo sapiens
uucuucuuagacauggcaa

SEQ ID NO: 1268 - RNA, 23 nt, Homo sapiens
ugcagcucugguggaaaauggag

SEQ ID NO: 1269 - RNA, 23 nt, Homo sapiens
cuccauuuuccaccagagcugca

SEQ ID NO: 1270 - RNA, 22 nt, Homo sapiens
caggauccacagagcuagucca

SEQ ID NO: 1271 - RNA, 22 nt, Homo sapiens
uggacuagcucuguggauccug

SEQ ID NO: 1272 - RNA, 22 nt, Homo sapiens
aacuagcucuguggauccugac

SEQ ID NO: 1273 - RNA, 22 nt, Homo sapiens
gucaggauccacagagcuaguu

SEQ ID NO: 1274 - RNA, 22 nt, Homo sapiens
aaagauggacaauuggcuaaau

SEQ ID NO: 1275 - RNA, 22 nt, Homo sapiens
auuuagccaauuguccaucuuu

SEQ ID NO: 1276 - RNA, 24 nt, Homo sapiens
agcugagcuccauggacgugcagu

SEQ ID NO: 1277 - RNA, 24 nt, Homo sapiens
acugcacguccauggagcucagcu

SEQ ID NO: 1278 - RNA, 22 nt, Homo sapiens
cuuccggucugugagccccguc

SEQ ID NO: 1279 - RNA, 22 nt, Homo sapiens
gacggggcucacagaccggaag

SEQ ID NO: 1280 - RNA, 22 nt, Homo sapiens
uggggugcccacuccgcaaguu

SEQ ID NO: 1281 - RNA, 22 nt, Homo sapiens
aacuugcggagugggcacccca

SEQ ID NO: 1282 - RNA, 26 nt, Homo sapiens
cucggccgcggcgcguagcccccgcc

SEQ ID NO: 1283 - RNA, 26 nt, Homo sapiens
ggcgggggcuacgcgccgcggccgag

SEQ ID NO: 1284 - RNA, 23 nt, Homo sapiens
cugggggacgcgugagcgcgagc

SEQ ID NO: 1285 - RNA, 23 nt, Homo sapiens
gcucgcgcucacgcgucccccag

SEQ ID NO: 1286 - RNA, 21 nt, Homo sapiens
cauacaaucugacauguauuu

SEQ ID NO: 1287 - RNA, 21 nt, Homo sapiens
aaauacaugucagauuguaug

SEQ ID NO: 1288 - RNA, 21 nt, Homo sapiens
auacaugucagauuguaugcc

SEQ ID NO: 1289 - RNA, 21 nt, Homo sapiens
ggcauacaaucugacauguau

SEQ ID NO: 1290 - RNA, 21 nt, Homo sapiens
ucccuccuucuguccccacag

SEQ ID NO: 1291 - RNA, 21 nt, Homo sapiens
cuguggggacagaaggaggga

SEQ ID NO: 1292 - RNA, 22 nt, Homo sapiens
acuggggagcagaaggagaacc

SEQ ID NO: 1293 - RNA, 22 nt, Homo sapiens
gguucuccuucugcuccccagu

SEQ ID NO: 1294 - RNA, 23 nt, Homo sapiens
gaaaauccuuuuuguuuuuccag

SEQ ID NO: 1295 - RNA, 23 nt, Homo sapiens
cuggaaaaacaaaaaggauuuuc

SEQ ID NO: 1296 - RNA, 23 nt, Homo sapiens
agggaaaaaaaaaaggauuuguc

SEQ ID NO: 1297 - RNA, 23 nt, Homo sapiens
gacaaauccuuuuuuuuuucccu

SEQ ID NO: 1298 - RNA, 22 nt, Homo sapiens
uguguccgggaaguggaggagg

SEQ ID NO: 1299 - RNA, 22 nt, Homo sapiens
ccuccuccacuucccggacaca

SEQ ID NO: 1300 - RNA, 22 nt, Homo sapiens
ugaaguuacaucauggucgcuu

SEQ ID NO: 1301 - RNA, 22 nt, Homo sapiens
aagcgaccaugauguaacuuca

SEQ ID NO: 1302 - RNA, 22 nt, Homo sapiens
aagcgaccaugauguaacuuca

SEQ ID NO: 1303 - RNA, 22 nt, Homo sapiens
ugaaguuacaucauggucgcuu

SEQ ID NO: 1304 - RNA, 21 nt, Homo sapiens
uuagugcauagucuuuggucu

SEQ ID NO: 1305 - RNA, 21 nt, Homo sapiens
agaccaaagacuaugcacuaa

SEQ ID NO: 1306 - RNA, 22 nt, Homo sapiens
accgaagacugugcgcuaaucu

SEQ ID NO: 1307 - RNA, 22 nt, Homo sapiens
agauuagcgcacagucuucggu

SEQ ID NO: 1308 - RNA, 21 nt, Homo sapiens
uuacacagcuggacagaggca

SEQ ID NO: 1309 - RNA, 21 nt, Homo sapiens
ugccucuguccagcuguguaa

SEQ ID NO: 1310 - RNA, 22 nt, Homo sapiens
uccaggcaggagccggacugga

SEQ ID NO: 1311 - RNA, 22 nt, Homo sapiens
uccaguccggcuccugccugga

SEQ ID NO: 1312 - RNA, 21 nt, Homo sapiens
cugggcucgggacgcgcggcu

SEQ ID NO: 1313 - RNA, 21 nt, Homo sapiens
agccgcgcgucccgagcccag

SEQ ID NO: 1314 - RNA, 22 nt, Homo sapiens
ggggcugugauugaccagcagg

SEQ ID NO: 1315 - RNA, 22 nt, Homo sapiens
ccugcuggucaaucacagcccc

SEQ ID NO: 1316 - RNA, 22 nt, Homo sapiens
cacuguuucaccacuggcucuu

SEQ ID NO: 1317 - RNA, 22 nt, Homo sapiens
aagagccaguggugaaacagug

SEQ ID NO: 1318 - RNA, 21 nt, Homo sapiens
gagccaguggugagacaguga

SEQ ID NO: 1319 - RNA, 21 nt, Homo sapiens
ucacugucucaccacuggcuc

SEQ ID NO: 1320 - RNA, 22 nt, Homo sapiens
aagguauuguucagacuuauga

SEQ ID NO: 1321 - RNA, 22 nt, Homo sapiens
ucauaagucugaacaauaccuu

SEQ ID NO: 1322 - RNA, 22 nt, Homo sapiens
ucugugauagagauucuuugcu

SEQ ID NO: 1323 - RNA, 22 nt, Homo sapiens
agcaaagaaucucuaucacaga

SEQ ID NO: 1324 - RNA, 21 nt, Homo sapiens
ucugaauuguaagaguuguua

SEQ ID NO: 1325 - RNA, 21 nt, Homo sapiens
uaacaacucuuacaauucaga

SEQ ID NO: 1326 - RNA, 23 nt, Homo sapiens
agaacucuugcagucuuagaugu

SEQ ID NO: 1327 - RNA, 23 nt, Homo sapiens
acaucuaagacugcaagaguucu

SEQ ID NO: 1328 - RNA, 22 nt, Homo sapiens
aacgggaaugcaggcuguaucu

SEQ ID NO: 1329 - RNA, 22 nt, Homo sapiens
agauacagccugcauucccguu

SEQ ID NO: 1330 - RNA, 23 nt, Homo sapiens
ucugaguuccuggagccuggucu

SEQ ID NO: 1331 - RNA, 23 nt, Homo sapiens
agaccaggcuccaggaacucaga

SEQ ID NO: 1332 - RNA, 23 nt, Homo sapiens
uggagauccagugcucgcccgau

SEQ ID NO: 1333 - RNA, 23 nt, Homo sapiens
aucgggcgagcacuggaucucca

SEQ ID NO: 1334 - RNA, 22 nt, Homo sapiens
uguugcaagucgguggagacgu

SEQ ID NO: 1335 - RNA, 22 nt, Homo sapiens
acgucuccaccgacuugcaaca

SEQ ID NO: 1336 - RNA, 22 nt, Homo sapiens
cucucuacugacuugcaacaua

SEQ ID NO: 1337 - RNA, 22 nt, Homo sapiens
uauguugcaagucaguagagag

SEQ ID NO: 1338 - RNA, 22 nt, Homo sapiens
ucucccuuccugcccuggcuag

SEQ ID NO: 1339 - RNA, 22 nt, Homo sapiens
cuagccagggcaggaagggaga

SEQ ID NO: 1340 - RNA, 26 nt, Homo sapiens
cccagggcuuggaguggggcaagguu

SEQ ID NO: 1341 - RNA, 26 nt, Homo sapiens
aaccuugccccacuccaagcccuggg

SEQ ID NO: 1342 - RNA, 23 nt, Homo sapiens
uaucugcugggcuuucugguguu

SEQ ID NO: 1343 - RNA, 23 nt, Homo sapiens
aacaccagaaagcccagcagaua

SEQ ID NO: 1344 - RNA, 21 nt, Homo sapiens
uggcuguuggagggggcaggc

SEQ ID NO: 1345 - RNA, 21 nt, Homo sapiens
gccugcccccuccaacagcca

SEQ ID NO: 1346 - RNA, 22 nt, Homo sapiens
cagcccuccucccgcacccaaa

SEQ ID NO: 1347 - RNA, 22 nt, Homo sapiens
uuugggugcgggaggagggcug

SEQ ID NO: 1348 - RNA, 22 nt, Homo sapiens
uaggggcagcagaggaccuggg

SEQ ID NO: 1349 - RNA, 22 nt, Homo sapiens
cccagguccucugcugccccua

SEQ ID NO: 1350 - RNA, 22 nt, Homo sapiens
uugaggagacauggugggggcc

SEQ ID NO: 1351 - RNA, 22 nt, Homo sapiens
ggcccccaccaugucuccucaa

SEQ ID NO: 1352 - RNA, 21 nt, Homo sapiens
gcagcccagcugaggccucug

SEQ ID NO: 1353 - RNA, 21 nt, Homo sapiens
cagaggccucagcugggcugc

SEQ ID NO: 1354 - RNA, 22 nt, Homo sapiens
gagcaggcgaggcugggcugaa

SEQ ID NO: 1355 - RNA, 22 nt, Homo sapiens
uucagcccagccucgccugcuc

SEQ ID NO: 1356 - RNA, 23 nt, Homo sapiens
ccagccacggacugagagugcau

SEQ ID NO: 1357 - RNA, 23 nt, Homo sapiens
augcacucucaguccguggcugg

SEQ ID NO: 1358 - RNA, 23 nt, Homo sapiens
guccuccaggccaugagcugcgg

SEQ ID NO: 1359 - RNA, 23 nt, Homo sapiens
ccgcagcucauggccuggaggac

SEQ ID NO: 1360 - RNA, 22 nt, Homo sapiens
ucaggcaguguggguaucagau

SEQ ID NO: 1361 - RNA, 22 nt, Homo sapiens
aucugauacccacacugccuga

SEQ ID NO: 1362 - RNA, 23 nt, Homo sapiens
ugagaguggaauucacaguauuu

SEQ ID NO: 1363 - RNA, 23 nt, Homo sapiens
aaauacugugaauuccacucuca

SEQ ID NO: 1364 - RNA, 23 nt, Homo sapiens
auacugugaauuucacugucaca

SEQ ID NO: 1365 - RNA, 23 nt, Homo sapiens
ugugacagugaaauucacaguau

SEQ ID NO: 1366 - RNA, 21 nt, Homo sapiens
caaauggacaggauaacaccu

SEQ ID NO: 1367 - RNA, 21 nt, Homo sapiens
agguguuauccuguccauuug

SEQ ID NO: 1368 - RNA, 22 nt, Homo sapiens
agguguuauccuauccauuugc

SEQ ID NO: 1369 - RNA, 22 nt, Homo sapiens
gcaaauggauaggauaacaccu

SEQ ID NO: 1370 - RNA, 22 nt, Homo sapiens
ugaucucaccgcugccuccuuc

SEQ ID NO: 1371 - RNA, 22 nt, Homo sapiens
gaaggaggcagcggugagauca

SEQ ID NO: 1372 - RNA, 22 nt, Homo sapiens
caggaggcagugggcgagcagg

SEQ ID NO: 1373 - RNA, 22 nt, Homo sapiens
ccugcucgcccacugccuccug

SEQ ID NO: 1374 - RNA, 22 nt, Homo sapiens
ugcaagacggauacugucaucu

SEQ ID NO: 1375 - RNA, 22 nt, Homo sapiens
agaugacaguauccgucuugca

SEQ ID NO: 1376 - RNA, 24 nt, Homo sapiens
ugucagugacuccugccccuuggu

SEQ ID NO: 1377 - RNA, 24 nt, Homo sapiens
accaaggggcaggagucacugaca

SEQ ID NO: 1378 - RNA, 22 nt, Homo sapiens
agggggcgcagucacugacgug

SEQ ID NO: 1379 - RNA, 22 nt, Homo sapiens
cacgucagugacugcgcccccu

SEQ ID NO: 1380 - RNA, 23 nt, Homo sapiens
ucaaaauguagaggaagacccca

SEQ ID NO: 1381 - RNA, 23 nt, Homo sapiens
uggggucuuccucuacauuuuga

SEQ ID NO: 1382 - RNA, 22 nt, Homo sapiens
aauuuacucugcaaucuucucc

SEQ ID NO: 1383 - RNA, 22 nt, Homo sapiens
ggagaagauugcagaguaaauu

SEQ ID NO: 1384 - RNA, 22 nt, Homo sapiens
agaagauugcagaguaaguucc

SEQ ID NO: 1385 - RNA, 22 nt, Homo sapiens
ggaacuuacucugcaaucuucu

SEQ ID NO: 1386 - RNA, 26 nt, Homo sapiens
cacaggacugacuccucaccccagug

SEQ ID NO: 1387 - RNA, 26 nt, Homo sapiens
cacuggggugaggagucaguccugug

SEQ ID NO: 1388 - RNA, 22 nt, Homo sapiens
ucuggggaugaggacagugugu

SEQ ID NO: 1389 - RNA, 22 nt, Homo sapiens
acacacuguccucauccccaga

SEQ ID NO: 1390 - RNA, 20 nt, Homo sapiens
augggugauggguguggugu

SEQ ID NO: 1391 - RNA, 20 nt, Homo sapiens
acaccacacccaucacccau

SEQ ID NO: 1392 - RNA, 22 nt, Homo sapiens
uuggccaccacaccuaccccuu

SEQ ID NO: 1393 - RNA, 22 nt, Homo sapiens
aagggguaggugugguggccaa

SEQ ID NO: 1394 - RNA, 22 nt, Homo sapiens
uguaguuguauuguauugccac

SEQ ID NO: 1395 - RNA, 22 nt, Homo sapiens
guggcaauacaauacaacuaca

SEQ ID NO: 1396 - RNA, 23 nt, Homo sapiens
uagcaauacaguacaaauauagu

SEQ ID NO: 1397 - RNA, 23 nt, Homo sapiens
acuauauuuguacuguauugcua

SEQ ID NO: 1398 - RNA, 22 nt, Homo sapiens
ucagucacauaucuagugucua

SEQ ID NO: 1399 - RNA, 22 nt, Homo sapiens
uagacacuagauaugugacuga

SEQ ID NO: 1400 - RNA, 22 nt, Homo sapiens
gacacuaggcaugugagugauu

SEQ ID NO: 1401 - RNA, 22 nt, Homo sapiens
aaucacucacaugccuaguguc

SEQ ID NO: 1402 - RNA, 22 nt, Homo sapiens
ucaaucacuugguaauugcugu

SEQ ID NO: 1403 - RNA, 22 nt, Homo sapiens
acagcaauuaccaagugauuga

SEQ ID NO: 1404 - RNA, 25 nt, Homo sapiens
agcggggaggaagugggcgcugcuu

SEQ ID NO: 1405 - RNA, 25 nt, Homo sapiens
aagcagcgcccacuuccuccccgcu

SEQ ID NO: 1406 - RNA, 22 nt, Homo sapiens
agcccgccccagccgagguucu

SEQ ID NO: 1407 - RNA, 22 nt, Homo sapiens
agaaccucggcuggggcgggcu

SEQ ID NO: 1408 - RNA, 23 nt, Homo sapiens
gccccggcgcgggcggguucugg

SEQ ID NO: 1409 - RNA, 23 nt, Homo sapiens
ccagaacccgcccgcgccggggc

SEQ ID NO: 1410 - RNA, 22 nt, Homo sapiens
agcaaggcggcaucucucugau

SEQ ID NO: 1411 - RNA, 22 nt, Homo sapiens
aucagagagaugccgccuugcu

SEQ ID NO: 1412 - RNA, 21 nt, Homo sapiens
agagaugccgccuugcuccuu

SEQ ID NO: 1413 - RNA, 21 nt, Homo sapiens
aaggagcaaggcggcaucucu

SEQ ID NO: 1414 - RNA, 23 nt, Homo sapiens
uugaagaggaggugcucuguagc

SEQ ID NO: 1415 - RNA, 23 nt, Homo sapiens
gcuacagagcaccuccucuucaa

SEQ ID NO: 1416 - RNA, 22 nt, Homo sapiens
acaacagugacuugcucuccaa

SEQ ID NO: 1417 - RNA, 22 nt, Homo sapiens
uuggagagcaagucacuguugu

SEQ ID NO: 1418 - RNA, 18 nt, Homo sapiens
gggugagggcaggugguu

SEQ ID NO: 1419 - RNA, 18 nt, Homo sapiens
aaccaccugcccucaccc

SEQ ID NO: 1420 - RNA, 18 nt, Homo sapiens
cgugucuucuggcuugau

SEQ ID NO: 1421 - RNA, 18 nt, Homo sapiens
aucaagccagaagacacg

SEQ ID NO: 1422 - RNA, 23 nt, Homo sapiens
ugcaucaggccagaagacaugag

SEQ ID NO: 1423 - RNA, 23 nt, Homo sapiens
cucaugucuucuggccugaugca

SEQ ID NO: 1424 - RNA, 21 nt, Homo sapiens
aaugagagaccuguacuguau

SEQ ID NO: 1425 - RNA, 21 nt, Homo sapiens
auacaguacaggucucucauu

SEQ ID NO: 1426 - RNA, 22 nt, Homo sapiens
uccaguacaggucucucauuuc

SEQ ID NO: 1427 - RNA, 22 nt, Homo sapiens
gaaaugagagaccuguacugga

SEQ ID NO: 1428 - RNA, 22 nt, Homo sapiens
ugggauccagacagugggagaa

SEQ ID NO: 1429 - RNA, 22 nt, Homo sapiens
uucucccacugucuggauccca

SEQ ID NO: 1430 - RNA, 22 nt, Homo sapiens
uucucccacuaccaggcuccca

SEQ ID NO: 1431 - RNA, 22 nt, Homo sapiens
ugggagccugguagugggagaa

SEQ ID NO: 1432 - RNA, 22 nt, Homo sapiens
ccaaccuagguggucagaguug

SEQ ID NO: 1433 - RNA, 22 nt, Homo sapiens
caacucugaccaccuagguugg

SEQ ID NO: 1434 - RNA, 22 nt, Homo sapiens
aacucugaccccuuagguugau

SEQ ID NO: 1435 - RNA, 22 nt, Homo sapiens
aucaaccuaaggggucagaguu

SEQ ID NO: 1436 - RNA, 23 nt, Homo sapiens
gugccaccuuaacugcagccaau

SEQ ID NO: 1437 - RNA, 23 nt, Homo sapiens
auuggcugcaguuaagguggcac

SEQ ID NO: 1438 - RNA, 22 nt, Homo sapiens
aaguuggcugcaguuaaggugg

SEQ ID NO: 1439 - RNA, 22 nt, Homo sapiens
ccaccuuaacugcagccaacuu

SEQ ID NO: 1440 - RNA, 22 nt, Homo sapiens
aagggggaaggaaacauggaga

SEQ ID NO: 1441 - RNA, 22 nt, Homo sapiens
ucuccauguuuccuucccccuu

SEQ ID NO: 1442 - RNA, 22 nt, Homo sapiens
uccauguuuccuucccccuucu

SEQ ID NO: 1443 - RNA, 22 nt, Homo sapiens
agaagggggaaggaaacaugga

SEQ ID NO: 1444 - RNA, 21 nt, Homo sapiens
acacauggguggcuguggccu

SEQ ID NO: 1445 - RNA, 21 nt, Homo sapiens
aggccacagccacccaugugu

SEQ ID NO: 1446 - RNA, 22 nt, Homo sapiens
uaggccacagccacccaugugu

SEQ ID NO: 1447 - RNA, 22 nt, Homo sapiens
acacauggguggcuguggccua

SEQ ID NO: 1448 - RNA, 21 nt, Homo sapiens
agcuguaccugaaaccaagca

SEQ ID NO: 1449 - RNA, 21 nt, Homo sapiens
ugcuugguuucagguacagcu

SEQ ID NO: 1450 - RNA, 22 nt, Homo sapiens
ucacaaaucuauaauaugcagg

SEQ ID NO: 1451 - RNA, 22 nt, Homo sapiens
ccugcauauuauagauuuguga

SEQ ID NO: 1452 - RNA, 21 nt, Homo sapiens
ugcuuaaguuguaccaaguau

SEQ ID NO: 1453 - RNA, 21 nt, Homo sapiens
auacuugguacaacuuaagca

SEQ ID NO: 1454 - RNA, 22 nt, Homo sapiens
ccuggcauauuugguauaacuu

SEQ ID NO: 1455 - RNA, 22 nt, Homo sapiens
aaguuauaccaaauaugccagg

SEQ ID NO: 1456 - RNA, 22 nt, Homo sapiens
ugagggcuccaggugacggugg

SEQ ID NO: 1457 - RNA, 22 nt, Homo sapiens
ccaccgucaccuggagcccuca

SEQ ID NO: 1458 - RNA, 22 nt, Homo sapiens
accugccagcaccucccugcag

SEQ ID NO: 1459 - RNA, 22 nt, Homo sapiens
cugcagggaggugcuggcaggu

SEQ ID NO: 1460 - RNA, 23 nt, Homo sapiens
ggcaggagggcugugccagguug

SEQ ID NO: 1461 - RNA, 23 nt, Homo sapiens
caaccuggcacagcccuccugcc

SEQ ID NO: 1462 - RNA, 22 nt, Homo sapiens
cccucucuggcuccuccccaaa

SEQ ID NO: 1463 - RNA, 22 nt, Homo sapiens
uuuggggaggagccagagaggg

SEQ ID NO: 1464 - RNA, 24 nt, Homo sapiens
ugggggagccaugagauaagagca

SEQ ID NO: 1465 - RNA, 24 nt, Homo sapiens
ugcucuuaucucauggcuccccca

SEQ ID NO: 1466 - RNA, 21 nt, Homo sapiens
guaccuucugguucagcuagu

SEQ ID NO: 1467 - RNA, 21 nt, Homo sapiens
acuagcugaaccagaagguac

SEQ ID NO: 1468 - RNA, 23 nt, Homo sapiens
aacugaaccaggagugagcuucg

SEQ ID NO: 1469 - RNA, 23 nt, Homo sapiens
cgaagcucacuccugguucaguu

SEQ ID NO: 1470 - RNA, 22 nt, Homo sapiens
uggggaaggcgucagugucggg

SEQ ID NO: 1471 - RNA, 22 nt, Homo sapiens
cccgacacugacgccuucccca

SEQ ID NO: 1472 - RNA, 21 nt, Homo sapiens
agacccugcagccuucccacc

SEQ ID NO: 1473 - RNA, 21 nt, Homo sapiens
ggugggaaggcugcagggucu

SEQ ID NO: 1474 - RNA, 22 nt, Homo sapiens
acccagguucccucuggccgca

SEQ ID NO: 1475 - RNA, 22 nt, Homo sapiens
ugcggccagagggaaccugggu

SEQ ID NO: 1476 - RNA, 23 nt, Homo sapiens
agggccagaggagccuggagugg

SEQ ID NO: 1477 - RNA, 23 nt, Homo sapiens
ccacuccaggcuccucuggcccu

SEQ ID NO: 1478 - RNA, 22 nt, Homo sapiens
auagugggaagcuggcagauuc

SEQ ID NO: 1479 - RNA, 22 nt, Homo sapiens
gaaucugccagcuucccacuau

SEQ ID NO: 1480 - RNA, 21 nt, Homo sapiens
aucugccagcuuccacagugg

SEQ ID NO: 1481 - RNA, 21 nt, Homo sapiens
ccacuguggaagcuggcagau

SEQ ID NO: 1482 - RNA, 25 nt, Homo sapiens
caugcugaccucccuccugccccag

SEQ ID NO: 1483 - RNA, 25 nt, Homo sapiens
cuggggcaggagggaggucagcaug

SEQ ID NO: 1484 - RNA, 23 nt, Homo sapiens
ugggaggggagaggcagcaagca

SEQ ID NO: 1485 - RNA, 23 nt, Homo sapiens
ugcuugcugccucuccccuccca

SEQ ID NO: 1486 - RNA, 22 nt, Homo sapiens
ucauuuaucuguugggaagcua

SEQ ID NO: 1487 - RNA, 22 nt, Homo sapiens
uagcuucccaacagauaaauga

SEQ ID NO: 1488 - RNA, 23 nt, Homo sapiens
cuggcggagcccauuccaugcca

SEQ ID NO: 1489 - RNA, 23 nt, Homo sapiens
uggcauggaaugggcuccgccag

SEQ ID NO: 1490 - RNA, 22 nt, Homo sapiens
cacacaaguggcccccaacacu

SEQ ID NO: 1491 - RNA, 22 nt, Homo sapiens
aguguugggggccacuugugug

SEQ ID NO: 1492 - RNA, 22 nt, Homo sapiens
ugcugggggccacaugagugug

SEQ ID NO: 1493 - RNA, 22 nt, Homo sapiens
cacacucauguggcccccagca

SEQ ID NO: 1494 - RNA, 21 nt, Homo sapiens
gcccugaccuguccuguucug

SEQ ID NO: 1495 - RNA, 21 nt, Homo sapiens
cagaacaggacaggucagggc

SEQ ID NO: 1496 - RNA, 23 nt, Homo sapiens
uguagagcagggagcaggaagcu

SEQ ID NO: 1497 - RNA, 23 nt, Homo sapiens
agcuuccugcucccugcucuaca

SEQ ID NO: 1498 - RNA, 22 nt, Homo sapiens
ccaccaggucuagcauugggau

SEQ ID NO: 1499 - RNA, 22 nt, Homo sapiens
aucccaaugcuagaccuggugg

SEQ ID NO: 1500 - RNA, 22 nt, Homo sapiens
aaucccaaugcuagacccggug

SEQ ID NO: 1501 - RNA, 22 nt, Homo sapiens
caccgggucuagcauugggauu

SEQ ID NO: 1502 - RNA, 22 nt, Homo sapiens
gcugcgggcugcggucagggcg

SEQ ID NO: 1503 - RNA, 22 nt, Homo sapiens
cgcccugaccgcagcccgcagc

SEQ ID NO: 1504 - RNA, 21 nt, Homo sapiens
aaaggugcucaaauuagacau

SEQ ID NO: 1505 - RNA, 21 nt, Homo sapiens
augucuaauuugagcaccuuu

SEQ ID NO: 1506 - RNA, 22 nt, Homo sapiens
ccuaauuugaacaccuucggua

SEQ ID NO: 1507 - RNA, 22 nt, Homo sapiens
uaccgaagguguucaaauuagg

SEQ ID NO: 1508 - RNA, 19 nt, Homo sapiens
aggcagguuaucugggcug

SEQ ID NO: 1509 - RNA, 19 nt, Homo sapiens
cagcccagauaaccugccu

SEQ ID NO: 1510 - RNA, 20 nt, Homo sapiens
augcgaggaugcugacagug

SEQ ID NO: 1511 - RNA, 20 nt, Homo sapiens
cacugucagcauccucgcau

SEQ ID NO: 1512 - RNA, 22 nt, Homo sapiens
ugaaacuggagcgccuggagga

SEQ ID NO: 1513 - RNA, 22 nt, Homo sapiens
uccuccaggcgcuccaguuuca

SEQ ID NO: 1514 - RNA, 22 nt, Homo sapiens
accagcgcguuuucaguuucau

SEQ ID NO: 1515 - RNA, 22 nt, Homo sapiens
augaaacugaaaacgcgcuggu

SEQ ID NO: 1516 - RNA, 25 nt, Homo sapiens
aagggaggaggagcggaggggcccu

SEQ ID NO: 1517 - RNA, 25 nt, Homo sapiens
agggccccuccgcuccuccucccuu

SEQ ID NO: 1518 - RNA, 22 nt, Homo sapiens
gcccgagaggauccgucccugc

SEQ ID NO: 1519 - RNA, 22 nt, Homo sapiens
gcagggacggauccucucgggc

SEQ ID NO: 1520 - RNA, 22 nt, Homo sapiens
aggacugauccucucgggcagg

SEQ ID NO: 1521 - RNA, 22 nt, Homo sapiens
ccugcccgagaggaucaguccu

SEQ ID NO: 1522 - RNA, 23 nt, Homo sapiens
ucaggcaaagggauauuuacaga

SEQ ID NO: 1523 - RNA, 23 nt, Homo sapiens
ucuguaaauaucccuuugccuga

SEQ ID NO: 1524 - RNA, 21 nt, Homo sapiens
uuucugucuuuucugguccag

SEQ ID NO: 1525 - RNA, 21 nt, Homo sapiens
cuggaccagaaaagacagaaa

SEQ ID NO: 1526 - RNA, 23 nt, Homo sapiens
uggccggaugggacaggaggcau

SEQ ID NO: 1527 - RNA, 23 nt, Homo sapiens
augccuccugucccauccggcca

SEQ ID NO: 1528 - RNA, 23 nt, Homo sapiens
ucuaaagacuagacuucgcuaug

SEQ ID NO: 1529 - RNA, 23 nt, Homo sapiens
cauagcgaagucuagucuuuaga

SEQ ID NO: 1530 - RNA, 23 nt, Homo sapiens
uggcccggcgacgucucacgguc

SEQ ID NO: 1531 - RNA, 23 nt, Homo sapiens
gaccgugagacgucgccgggcca

SEQ ID NO: 1532 - RNA, 23 nt, Homo sapiens
ugaguggggcucccgggacggcg

SEQ ID NO: 1533 - RNA, 23 nt, Homo sapiens
cgccgucccgggagccccacuca

SEQ ID NO: 1534 - RNA, 21 nt, Homo sapiens
agcggugcuccugcgggccga

SEQ ID NO: 1535 - RNA, 21 nt, Homo sapiens
ucggcccgcaggagcaccgcu

SEQ ID NO: 1536 - RNA, 23 nt, Homo sapiens
ccggucccaggagaaccugcaga

SEQ ID NO: 1537 - RNA, 23 nt, Homo sapiens
ucugcagguucuccugggaccgg

SEQ ID NO: 1538 - RNA, 22 nt, Homo sapiens
aaggcccgggcuuuccucccag

SEQ ID NO: 1539 - RNA, 22 nt, Homo sapiens
cugggaggaaagcccgggccuu

SEQ ID NO: 1540 - RNA, 22 nt, Homo sapiens
agggaaggaggcuuggucuuag

SEQ ID NO: 1541 - RNA, 22 nt, Homo sapiens
cuaagaccaagccuccuucccu

SEQ ID NO: 1542 - RNA, 21 nt, Homo sapiens
gagguuuggggaggauuugcu

SEQ ID NO: 1543 - RNA, 21 nt, Homo sapiens
agcaaauccuccccaaaccuc

SEQ ID NO: 1544 - RNA, 20 nt, Homo sapiens
cgccccuccugcccccacag

SEQ ID NO: 1545 - RNA, 20 nt, Homo sapiens
cugugggggcaggaggggcg

SEQ ID NO: 1546 - RNA, 22 nt, Homo sapiens
ugcggggacaggccagggcauc

SEQ ID NO: 1547 - RNA, 22 nt, Homo sapiens
gaugcccuggccuguccccgca

SEQ ID NO: 1548 - RNA, 22 nt, Homo sapiens
ccugacccacccccucccgcag

SEQ ID NO: 1549 - RNA, 22 nt, Homo sapiens
cugcgggagggggugggucagg

SEQ ID NO: 1550 - RNA, 22 nt, Homo sapiens
cucgggcggaggugguugagug

SEQ ID NO: 1551 - RNA, 22 nt, Homo sapiens
cacucaaccaccuccgcccgag

SEQ ID NO: 1552 - RNA, 24 nt, Homo sapiens
agaggacccguagcugcuagaagg

SEQ ID NO: 1553 - RNA, 24 nt, Homo sapiens
ccuucuagcagcuacggguccucu

SEQ ID NO: 1554 - RNA, 22 nt, Homo sapiens
uuguggaucucaaggaugugcu

SEQ ID NO: 1555 - RNA, 22 nt, Homo sapiens
agcacauccuugagauccacaa

SEQ ID NO: 1556 - RNA, 22 nt, Homo sapiens
uucucuuucuuuagccuugugu

SEQ ID NO: 1557 - RNA, 22 nt, Homo sapiens
acacaaggcuaaagaaagagaa

SEQ ID NO: 1558 - RNA, 22 nt, Homo sapiens
caaggccaaaggaagagaacag

SEQ ID NO: 1559 - RNA, 22 nt, Homo sapiens
cuguucucuuccuuuggccuug

SEQ ID NO: 1560 - RNA, 23 nt, Homo sapiens
augcggaccuggguuagcggagu

SEQ ID NO: 1561 - RNA, 23 nt, Homo sapiens
acuccgcuaacccagguccgcau

SEQ ID NO: 1562 - RNA, 22 nt, Homo sapiens
agccaggcucugaagggaaagu

SEQ ID NO: 1563 - RNA, 22 nt, Homo sapiens
acuuucccuucagagccuggcu

SEQ ID NO: 1564 - RNA, 22 nt, Homo sapiens
uuucccuucagagccuggcuuu

SEQ ID NO: 1565 - RNA, 22 nt, Homo sapiens
aaagccaggcucugaagggaaa

SEQ ID NO: 1566 - RNA, 22 nt, Homo sapiens
ccagagaugguugccuuccuau

SEQ ID NO: 1567 - RNA, 22 nt, Homo sapiens
auaggaaggcaaccaucucugg

SEQ ID NO: 1568 - RNA, 23 nt, Homo sapiens
cagggaggcgcucacucucugcu

SEQ ID NO: 1569 - RNA, 23 nt, Homo sapiens
agcagagagugagcgccucccug

SEQ ID NO: 1570 - RNA, 22 nt, Homo sapiens
caugacgucacagaggcuucgc

SEQ ID NO: 1571 - RNA, 22 nt, Homo sapiens
gcgaagccucugugacgucaug

SEQ ID NO: 1572 - RNA, 23 nt, Homo sapiens
aggccucugugacgucacggugu

SEQ ID NO: 1573 - RNA, 23 nt, Homo sapiens
acaccgugacgucacagaggccu

SEQ ID NO: 1574 - RNA, 23 nt, Homo sapiens
ugccccaccugcugaccacccuc

SEQ ID NO: 1575 - RNA, 23 nt, Homo sapiens
gaggguggucagcagguggggca

SEQ ID NO: 1576 - RNA, 23 nt, Homo sapiens
gugagugggagccgguggggcug

SEQ ID NO: 1577 - RNA, 23 nt, Homo sapiens
cagccccaccggcucccacucac

SEQ ID NO: 1578 - RNA, 21 nt, Homo sapiens
uaggacuagauguuggaauua

SEQ ID NO: 1579 - RNA, 21 nt, Homo sapiens
uaauuccaacaucuaguccua

SEQ ID NO: 1580 - RNA, 22 nt, Homo sapiens
aaauucauguucaaucuaaacc

SEQ ID NO: 1581 - RNA, 22 nt, Homo sapiens
gguuuagauugaacaugaauuu

SEQ ID NO: 1582 - RNA, 22 nt, Homo sapiens
uuuagauugaacaugaaguuag

SEQ ID NO: 1583 - RNA, 22 nt, Homo sapiens
cuaacuucauguucaaucuaaa

SEQ ID NO: 1584 - RNA, 21 nt, Homo sapiens
gagggcaugcgcacuuugucc

SEQ ID NO: 1585 - RNA, 21 nt, Homo sapiens
ggacaaagugcgcaugcccuc

SEQ ID NO: 1586 - RNA, 21 nt, Homo sapiens
acaaggugugcaugccugacc

SEQ ID NO: 1587 - RNA, 21 nt, Homo sapiens
ggucaggcaugcacaccuugu

SEQ ID NO: 1588 - RNA, 22 nt, Homo sapiens
cuucugaucaagauuuguggug

SEQ ID NO: 1589 - RNA, 22 nt, Homo sapiens
caccacaaaucuugaucagaag

SEQ ID NO: 1590 - RNA, 21 nt, Homo sapiens
ccaaaucuugaucagaagccu

SEQ ID NO: 1591 - RNA, 21 nt, Homo sapiens
aggcuucugaucaagauuugg

SEQ ID NO: 1592 - RNA, 24 nt, Homo sapiens
aggcaggggcuggugcugggcggg

SEQ ID NO: 1593 - RNA, 24 nt, Homo sapiens
cccgcccagcaccagccccugccu

SEQ ID NO: 1594 - RNA, 21 nt, Homo sapiens
cgccugcccagcccuccugcu

SEQ ID NO: 1595 - RNA, 21 nt, Homo sapiens
agcaggagggcugggcaggcg

SEQ ID NO: 1596 - RNA, 22 nt, Homo sapiens
uuaacuccuuucacacccaugg

SEQ ID NO: 1597 - RNA, 22 nt, Homo sapiens
ccaugggugugaaaggaguuaa

SEQ ID NO: 1598 - RNA, 21 nt, Homo sapiens
uggauguggaaggaguuaucu

SEQ ID NO: 1599 - RNA, 21 nt, Homo sapiens
agauaacuccuuccacaucca

SEQ ID NO: 1600 - RNA, 22 nt, Homo sapiens
ugagugauugauagcuauguuc

SEQ ID NO: 1601 - RNA, 22 nt, Homo sapiens
gaacauagcuaucaaucacuca

SEQ ID NO: 1602 - RNA, 21 nt, Homo sapiens
auagcaauugcucuuuuggaa

SEQ ID NO: 1603 - RNA, 21 nt, Homo sapiens
uuccaaaagagcaauugcuau

SEQ ID NO: 1604 - RNA, 21 nt, Homo sapiens
ucugaaagagcaguugguguu

SEQ ID NO: 1605 - RNA, 21 nt, Homo sapiens
aacaccaacugcucuuucaga

SEQ ID NO: 1606 - RNA, 23 nt, Homo sapiens
cgcgggcgcuccuggccgccgcc

SEQ ID NO: 1607 - RNA, 23 nt, Homo sapiens
ggcggcggccaggagcgcccgcg

SEQ ID NO: 1608 - RNA, 20 nt, Homo sapiens
ccaggagauccagagagaau

SEQ ID NO: 1609 - RNA, 20 nt, Homo sapiens
auucucucuggaucuccugg

SEQ ID NO: 1610 - RNA, 22 nt, Homo sapiens
auucucucuggaucccauggau

SEQ ID NO: 1611 - RNA, 22 nt, Homo sapiens
auccaugggauccagagagaau

SEQ ID NO: 1612 - RNA, 22 nt, Homo sapiens
ucugccauccucccuccccuac

SEQ ID NO: 1613 - RNA, 22 nt, Homo sapiens
guaggggagggaggauggcaga

SEQ ID NO: 1614 - RNA, 24 nt, Homo sapiens
ggugggauggagagaagguaugag

SEQ ID NO: 1615 - RNA, 24 nt, Homo sapiens
cucauaccuucucuccaucccacc

SEQ ID NO: 1616 - RNA, 18 nt, Homo sapiens
ugagaugacacuguagcu

SEQ ID NO: 1617 - RNA, 18 nt, Homo sapiens
agcuacagugucaucuca

SEQ ID NO: 1618 - RNA, 21 nt, Homo sapiens
agcagacuugaccuacaauua

SEQ ID NO: 1619 - RNA, 21 nt, Homo sapiens
uaauuguaggucaagucugcu

SEQ ID NO: 1620 - RNA, 22 nt, Homo sapiens
cagaacaggagcauagaaaggc

SEQ ID NO: 1621 - RNA, 22 nt, Homo sapiens
gccuuucuaugcuccuguucug

SEQ ID NO: 1622 - RNA, 22 nt, Homo sapiens
uuaauuuuuuguuucggucacu

SEQ ID NO: 1623 - RNA, 22 nt, Homo sapiens
agugaccgaaacaaaaaauuaa

SEQ ID NO: 1624 - RNA, 23 nt, Homo sapiens
cuugccauccugguccacugcau

SEQ ID NO: 1625 - RNA, 23 nt, Homo sapiens
augcaguggaccaggauggcaag

SEQ ID NO: 1626 - RNA, 22 nt, Homo sapiens
guggaccaggauggcaagggcu

SEQ ID NO: 1627 - RNA, 22 nt, Homo sapiens
agcccuugccauccugguccac

SEQ ID NO: 1628 - RNA, 22 nt, Homo sapiens
auaccucaucuagaaugcugua

SEQ ID NO: 1629 - RNA, 22 nt, Homo sapiens
uacagcauucuagaugagguau

SEQ ID NO: 1630 - RNA, 22 nt, Homo sapiens
uucuagaugagagauauauaua

SEQ ID NO: 1631 - RNA, 22 nt, Homo sapiens
uauauauaucucucaucuagaa

SEQ ID NO: 1632 - RNA, 22 nt, Homo sapiens
ucuucuuccuuugcagaguuga

SEQ ID NO: 1633 - RNA, 22 nt, Homo sapiens
ucaacucugcaaaggaagaaga

SEQ ID NO: 1634 - RNA, 22 nt, Homo sapiens
aauucuguaaaggaagaagagg

SEQ ID NO: 1635 - RNA, 22 nt, Homo sapiens
ccucuucuuccuuuacagaauu

SEQ ID NO: 1636 - RNA, 22 nt, Homo sapiens
uaggagggaauaguaaaagcag

SEQ ID NO: 1637 - RNA, 22 nt, Homo sapiens
cugcuuuuacuauucccuccua

SEQ ID NO: 1638 - RNA, 22 nt, Homo sapiens
acccuugagccugaucccuagc

SEQ ID NO: 1639 - RNA, 22 nt, Homo sapiens
gcuagggaucaggcucaagggu

SEQ ID NO: 1640 - RNA, 22 nt, Homo sapiens
aauguuggaauccucgcuagag

SEQ ID NO: 1641 - RNA, 22 nt, Homo sapiens
cucuagcgaggauuccaacauu

SEQ ID NO: 1642 - RNA, 21 nt, Homo sapiens
uagcggggauuccaauauugg

SEQ ID NO: 1643 - RNA, 21 nt, Homo sapiens
ccaauauuggaauccccgcua

SEQ ID NO: 1644 - RNA, 22 nt, Homo sapiens
ugauugucuucauaucuagaac

SEQ ID NO: 1645 - RNA, 22 nt, Homo sapiens
guucuagauaugaagacaauca

SEQ ID NO: 1646 - RNA, 22 nt, Homo sapiens
uucuggauaugaagacaaucaa

SEQ ID NO: 1647 - RNA, 22 nt, Homo sapiens
uugauugucuucauauccagaa

SEQ ID NO: 1648 - RNA, 23 nt, Homo sapiens
ccccgguguuggggcgcgucugc

SEQ ID NO: 1649 - RNA, 23 nt, Homo sapiens
gcagacgcgccccaacaccgggg

SEQ ID NO: 1650 - RNA, 21 nt, Homo sapiens
ggcgcgcccagcucccgggcu

SEQ ID NO: 1651 - RNA, 21 nt, Homo sapiens
agcccgggagcugggcgcgcc

SEQ ID NO: 1652 - RNA, 20 nt, Homo sapiens
ugaggagaugcugggacuga

SEQ ID NO: 1653 - RNA, 20 nt, Homo sapiens
ucagucccagcaucuccuca

SEQ ID NO: 1654 - RNA, 21 nt, Homo sapiens
agagucggcgacgccgccagc

SEQ ID NO: 1655 - RNA, 21 nt, Homo sapiens
gcuggcggcgucgccgacucu

SEQ ID NO: 1656 - RNA, 22 nt, Homo sapiens
ugaagccagcucuggucugggc

SEQ ID NO: 1657 - RNA, 22 nt, Homo sapiens
gcccagaccagagcuggcuuca

SEQ ID NO: 1658 - RNA, 22 nt, Homo sapiens
ugagaccaggacuggaugcacc

SEQ ID NO: 1659 - RNA, 22 nt, Homo sapiens
ggugcauccaguccuggucuca

SEQ ID NO: 1660 - RNA, 24 nt, Homo sapiens
gaugcgccgcccacugccccgcgc

SEQ ID NO: 1661 - RNA, 24 nt, Homo sapiens
gcgcggggcagugggcggcgcauc

SEQ ID NO: 1662 - RNA, 22 nt, Homo sapiens
gcggggguggcggcggcauccc

SEQ ID NO: 1663 - RNA, 22 nt, Homo sapiens
gggaugccgccgccacccccgc

SEQ ID NO: 1664 - RNA, 22 nt, Homo sapiens
uuacggaccagcuaagggaggc

SEQ ID NO: 1665 - RNA, 22 nt, Homo sapiens
gccucccuuagcugguccguaa

SEQ ID NO: 1666 - RNA, 21 nt, Homo sapiens
cacacauagcagguguauaua

SEQ ID NO: 1667 - RNA, 21 nt, Homo sapiens
uauauacaccugcuaugugug

SEQ ID NO: 1668 - RNA, 22 nt, Homo sapiens
guauacaccugauauguguaug

SEQ ID NO: 1669 - RNA, 22 nt, Homo sapiens
cauacacauaucagguguauac

SEQ ID NO: 1670 - RNA, 22 nt, Homo sapiens
ugaaugguaaagcgaugucaca

SEQ ID NO: 1671 - RNA, 22 nt, Homo sapiens
ugugacaucgcuuuaccauuca

SEQ ID NO: 1672 - RNA, 20 nt, Homo sapiens
aucgcuuuaccauucauguu

SEQ ID NO: 1673 - RNA, 20 nt, Homo sapiens
aacaugaaugguaaagcgau

SEQ ID NO: 1674 - RNA, 18 nt, Homo sapiens
uggauaugaugacugaaa

SEQ ID NO: 1675 - RNA, 18 nt, Homo sapiens
uuucagucaucauaucca

SEQ ID NO: 1676 - RNA, 18 nt, Homo sapiens
cggugagcgcucgcuggc

SEQ ID NO: 1677 - RNA, 18 nt, Homo sapiens
gccagcgagcgcucaccg

SEQ ID NO: 1678 - RNA, 23 nt, Homo sapiens
ucugcacugugaguuggcuggcu

SEQ ID NO: 1679 - RNA, 23 nt, Homo sapiens
agccagccaacucacagugcaga

SEQ ID NO: 1680 - RNA, 24 nt, Homo sapiens
acauccugcuccacagggcagagg

SEQ ID NO: 1681 - RNA, 24 nt, Homo sapiens
ccucugcccuguggagcaggaugu

SEQ ID NO: 1682 - RNA, 22 nt, Homo sapiens
ucuggcuaucucacgagacugu

SEQ ID NO: 1683 - RNA, 22 nt, Homo sapiens
acagucucgugagauagccaga

SEQ ID NO: 1684 - RNA, 22 nt, Homo sapiens
auauuauuagccacuucuggau

SEQ ID NO: 1685 - RNA, 22 nt, Homo sapiens
auccagaaguggcuaauaauau

SEQ ID NO: 1686 - RNA, 21 nt, Homo sapiens
agaaguggcuaauaauauuga

SEQ ID NO: 1687 - RNA, 21 nt, Homo sapiens
ucaauauuauuagccacuucu

SEQ ID NO: 1688 - RNA, 22 nt, Homo sapiens
uaaaguggcagaguauagacac

SEQ ID NO: 1689 - RNA, 22 nt, Homo sapiens
gugucuauacucugccacuuua

SEQ ID NO: 1690 - RNA, 22 nt, Homo sapiens
ugucuauacucugucacuuuac

SEQ ID NO: 1691 - RNA, 22 nt, Homo sapiens
guaaagugacagaguauagaca

SEQ ID NO: 1692 - RNA, 21 nt, Homo sapiens
ucucaguaaguggcacucugu

SEQ ID NO: 1693 - RNA, 21 nt, Homo sapiens
acagagugccacuuacugaga

SEQ ID NO: 1694 - RNA, 21 nt, Homo sapiens
gacagagugccacuuacugaa

SEQ ID NO: 1695 - RNA, 21 nt, Homo sapiens
uucaguaaguggcacucuguc

SEQ ID NO: 1696 - RNA, 22 nt, Homo sapiens
aacucacgaaguauaccgaagu

SEQ ID NO: 1697 - RNA, 22 nt, Homo sapiens
acuucgguauacuucgugaguu

SEQ ID NO: 1698 - RNA, 22 nt, Homo sapiens
uucgguauacuuugugaauugg

SEQ ID NO: 1699 - RNA, 22 nt, Homo sapiens
ccaauucacaaaguauaccgaa

SEQ ID NO: 1700 - RNA, 22 nt, Homo sapiens
acuggcaugcugcauuuauaua

SEQ ID NO: 1701 - RNA, 22 nt, Homo sapiens
uauauaaaugcagcaugccagu

SEQ ID NO: 1702 - RNA, 22 nt, Homo sapiens
aucuaaaugcagcaugccaguc

SEQ ID NO: 1703 - RNA, 22 nt, Homo sapiens
gacuggcaugcugcauuuagau

SEQ ID NO: 1704 - RNA, 19 nt, Homo sapiens
cauccguccgucuguccac

SEQ ID NO: 1705 - RNA, 19 nt, Homo sapiens
guggacagacggacggaug

SEQ ID NO: 1706 - RNA, 21 nt, Homo sapiens
aguggaccgaggaaggaagga

SEQ ID NO: 1707 - RNA, 21 nt, Homo sapiens
uccuuccuuccucgguccacu

SEQ ID NO: 1708 - RNA, 22 nt, Homo sapiens
uacacaagaaaaccaaggcuca

SEQ ID NO: 1709 - RNA, 22 nt, Homo sapiens
ugagccuugguuuucuugugua

SEQ ID NO: 1710 - RNA, 21 nt, Homo sapiens
uaacauaauaguguggauuga

SEQ ID NO: 1711 - RNA, 21 nt, Homo sapiens
ucaauccacacuauuauguua

SEQ ID NO: 1712 - RNA, 21 nt, Homo sapiens
ugcuuaaccuugcccucgaaa

SEQ ID NO: 1713 - RNA, 21 nt, Homo sapiens
uuucgagggcaagguuaagca

SEQ ID NO: 1714 - RNA, 21 nt, Homo sapiens
uuggacgguaagguuaagcaa

SEQ ID NO: 1715 - RNA, 21 nt, Homo sapiens
uugcuuaaccuuaccguccaa

SEQ ID NO: 1716 - RNA, 21 nt, Homo sapiens
aaaagcaucaggaaguaccca

SEQ ID NO: 1717 - RNA, 21 nt, Homo sapiens
uggguacuuccugaugcuuuu

SEQ ID NO: 1718 - RNA, 21 nt, Homo sapiens
gcaggacaggcagaaguggau

SEQ ID NO: 1719 - RNA, 21 nt, Homo sapiens
auccacuucugccuguccugc

SEQ ID NO: 1720 - RNA, 22 nt, Homo sapiens
cagggcuggcagugacaugggu

SEQ ID NO: 1721 - RNA, 22 nt, Homo sapiens
acccaugucacugccagcccug

SEQ ID NO: 1722 - RNA, 22 nt, Homo sapiens
auuucccugccauucccuuggc

SEQ ID NO: 1723 - RNA, 22 nt, Homo sapiens
gccaagggaauggcagggaaau

SEQ ID NO: 1724 - RNA, 22 nt, Homo sapiens
uggcggcgguaguuaugggcuu

SEQ ID NO: 1725 - RNA, 22 nt, Homo sapiens
aagcccauaacuaccgccgcca

SEQ ID NO: 1726 - RNA, 22 nt, Homo sapiens
gcucccucuagggucgcucgga

SEQ ID NO: 1727 - RNA, 22 nt, Homo sapiens
uccgagcgacccuagagggagc

SEQ ID NO: 1728 - RNA, 22 nt, Homo sapiens
ugggaacuuaguagagguuuaa

SEQ ID NO: 1729 - RNA, 22 nt, Homo sapiens
uuaaaccucuacuaaguuccca

SEQ ID NO: 1730 - RNA, 21 nt, Homo sapiens
uggggcuagugaugcaggacg

SEQ ID NO: 1731 - RNA, 21 nt, Homo sapiens
cguccugcaucacuagcccca

SEQ ID NO: 1732 - RNA, 22 nt, Homo sapiens
gcugacagcagggcuggccgcu

SEQ ID NO: 1733 - RNA, 22 nt, Homo sapiens
agcggccagcccugcugucagc

SEQ ID NO: 1734 - RNA, 21 nt, Homo sapiens
auuggacugcugauggcccgu

SEQ ID NO: 1735 - RNA, 21 nt, Homo sapiens
acgggccaucagcaguccaau

SEQ ID NO: 1736 - RNA, 22 nt, Homo sapiens
aggccaucagcaguccaaugaa

SEQ ID NO: 1737 - RNA, 22 nt, Homo sapiens
uucauuggacugcugauggccu

SEQ ID NO: 1738 - RNA, 22 nt, Homo sapiens
uuggacagaaaacacgcaggaa

SEQ ID NO: 1739 - RNA, 22 nt, Homo sapiens
uuccugcguguuuucuguccaa

SEQ ID NO: 1740 - RNA, 20 nt, Homo sapiens
ccugcguguuuucuguccaa

SEQ ID NO: 1741 - RNA, 20 nt, Homo sapiens
uuggacagaaaacacgcagg

SEQ ID NO: 1742 - RNA, 22 nt, Homo sapiens
ugagacaggcuuaugcugcuau

SEQ ID NO: 1743 - RNA, 22 nt, Homo sapiens
auagcagcauaagccugucuca

SEQ ID NO: 1744 - RNA, 22 nt, Homo sapiens
auagcagcaugaaccugucuca

SEQ ID NO: 1745 - RNA, 22 nt, Homo sapiens
ugagacagguucaugcugcuau

SEQ ID NO: 1746 - RNA, 20 nt, Homo sapiens
gagacagguucaugcugcua

SEQ ID NO: 1747 - RNA, 20 nt, Homo sapiens
uagcagcaugaaccugucuc

SEQ ID NO: 1748 - RNA, 21 nt, Homo sapiens
auagcagcauaagccugucuc

SEQ ID NO: 1749 - RNA, 21 nt, Homo sapiens
gagacaggcuuaugcugcuau

SEQ ID NO: 1750 - RNA, 22 nt, Homo sapiens
uguguggauccuggaggaggca

SEQ ID NO: 1751 - RNA, 22 nt, Homo sapiens
ugccuccuccaggauccacaca

SEQ ID NO: 1752 - RNA, 22 nt, Homo sapiens
agacaucaagaucagucccaaa

SEQ ID NO: 1753 - RNA, 22 nt, Homo sapiens
uuugggacugaucuugaugucu

SEQ ID NO: 1754 - RNA, 22 nt, Homo sapiens
uuugggacugaucuugaugucu

SEQ ID NO: 1755 - RNA, 22 nt, Homo sapiens
agacaucaagaucagucccaaa

SEQ ID NO: 1756 - RNA, 22 nt, Homo sapiens
aaggaaccagaaaaugagaagu

SEQ ID NO: 1757 - RNA, 22 nt, Homo sapiens
acuucucauuuucugguuccuu

SEQ ID NO: 1758 - RNA, 22 nt, Homo sapiens
ucuggccuugacuugacucuuu

SEQ ID NO: 1759 - RNA, 22 nt, Homo sapiens
aaagagucaagucaaggccaga

SEQ ID NO: 1760 - RNA, 23 nt, Homo sapiens
ucaaggccagaggucccacagca

SEQ ID NO: 1761 - RNA, 23 nt, Homo sapiens
ugcugugggaccucuggccuuga

SEQ ID NO: 1762 - RNA, 21 nt, Homo sapiens
acuccaguuuuaguucucuug

SEQ ID NO: 1763 - RNA, 21 nt, Homo sapiens
caagagaacuaaaacuggagu

SEQ ID NO: 1764 - RNA, 22 nt, Homo sapiens
aagagaacugaaaguggagccu

SEQ ID NO: 1765 - RNA, 22 nt, Homo sapiens
aggcuccacuuucaguucucuu

SEQ ID NO: 1766 - RNA, 22 nt, Homo sapiens
uaagggguguauggcagaugca

SEQ ID NO: 1767 - RNA, 22 nt, Homo sapiens
ugcaucugccauacaccccuua

SEQ ID NO: 1768 - RNA, 21 nt, Homo sapiens
uuucagauaacaguauuacau

SEQ ID NO: 1769 - RNA, 21 nt, Homo sapiens
auguaauacuguuaucugaaa

SEQ ID NO: 1770 - RNA, 22 nt, Homo sapiens
aagcaauacuguuaccugaaau

SEQ ID NO: 1771 - RNA, 22 nt, Homo sapiens
auuucagguaacaguauugcuu

SEQ ID NO: 1772 - RNA, 22 nt, Homo sapiens
uacuaacugcagauucaaguga

SEQ ID NO: 1773 - RNA, 22 nt, Homo sapiens
ucacuugaaucugcaguuagua

SEQ ID NO: 1774 - RNA, 21 nt, Homo sapiens
auugccuaacaugugccagaa

SEQ ID NO: 1775 - RNA, 21 nt, Homo sapiens
uucuggcacauguuaggcaau

SEQ ID NO: 1776 - RNA, 22 nt, Homo sapiens
ucugguauguaguagguaauaa

SEQ ID NO: 1777 - RNA, 22 nt, Homo sapiens
uuauuaccuacuacauaccaga

SEQ ID NO: 1778 - RNA, 22 nt, Homo sapiens
aguugccuuuuuguucccaugc

SEQ ID NO: 1779 - RNA, 22 nt, Homo sapiens
gcaugggaacaaaaaggcaacu

SEQ ID NO: 1780 - RNA, 21 nt, Homo sapiens
auaggcaccaaaaagcaacaa

SEQ ID NO: 1781 - RNA, 21 nt, Homo sapiens
uuguugcuuuuuggugccuau

SEQ ID NO: 1782 - RNA, 22 nt, Homo sapiens
ccugcaacuuugccugaucaga

SEQ ID NO: 1783 - RNA, 22 nt, Homo sapiens
ucugaucaggcaaaguugcagg

SEQ ID NO: 1784 - RNA, 22 nt, Homo sapiens
ugaucaggcaaaauugcagacu

SEQ ID NO: 1785 - RNA, 22 nt, Homo sapiens
agucugcaauuuugccugauca

SEQ ID NO: 1786 - RNA, 22 nt, Homo sapiens
uuguggcuggucaugaggcuaa

SEQ ID NO: 1787 - RNA, 22 nt, Homo sapiens
uuagccucaugaccagccacaa

SEQ ID NO: 1788 - RNA, 21 nt, Homo sapiens
uuagucucaugaucagacaca

SEQ ID NO: 1789 - RNA, 21 nt, Homo sapiens
ugugucugaucaugagacuaa

SEQ ID NO: 1790 - RNA, 22 nt, Homo sapiens
aaagauagacaauuggcuaaau

SEQ ID NO: 1791 - RNA, 22 nt, Homo sapiens
auuuagccaauugucuaucuuu

SEQ ID NO: 1792 - RNA, 22 nt, Homo sapiens
uuagccaauuguccaucuuuag

SEQ ID NO: 1793 - RNA, 22 nt, Homo sapiens
cuaaagauggacaauuggcuaa

SEQ ID NO: 1794 - RNA, 22 nt, Homo sapiens
ucugugagaccaaagaacuacu

SEQ ID NO: 1795 - RNA, 22 nt, Homo sapiens
aguaguucuuuggucucacaga

SEQ ID NO: 1796 - RNA, 22 nt, Homo sapiens
uuguucuuuggucuuucagcca

SEQ ID NO: 1797 - RNA, 22 nt, Homo sapiens
uggcugaaagaccaaagaacaa

SEQ ID NO: 1798 - RNA, 23 nt, Homo sapiens
cgggcuguccggaggggucggcu

SEQ ID NO: 1799 - RNA, 23 nt, Homo sapiens
agccgaccccuccggacagcccg

SEQ ID NO: 1800 - RNA, 23 nt, Homo sapiens
ucuguauucuccuuugccugcag

SEQ ID NO: 1801 - RNA, 23 nt, Homo sapiens
cugcaggcaaaggagaauacaga

SEQ ID NO: 1802 - RNA, 23 nt, Homo sapiens
uacauggauggaaaccuucaagc

SEQ ID NO: 1803 - RNA, 23 nt, Homo sapiens
gcuugaagguuuccauccaugua

SEQ ID NO: 1804 - RNA, 22 nt, Homo sapiens
uauggagguucuagaccauguu

SEQ ID NO: 1805 - RNA, 22 nt, Homo sapiens
aacauggucuagaaccuccaua

SEQ ID NO: 1806 - RNA, 22 nt, Homo sapiens
gggaccauccugccugcugugg

SEQ ID NO: 1807 - RNA, 22 nt, Homo sapiens
ccacagcaggcaggaugguccc

SEQ ID NO: 1808 - RNA, 22 nt, Homo sapiens
ucagcaggcaggcuggugcagc

SEQ ID NO: 1809 - RNA, 22 nt, Homo sapiens
gcugcaccagccugccugcuga

SEQ ID NO: 1810 - RNA, 22 nt, Homo sapiens
ucaccugaccucccaugccugu

SEQ ID NO: 1811 - RNA, 22 nt, Homo sapiens
acaggcaugggaggucagguga

SEQ ID NO: 1812 - RNA, 22 nt, Homo sapiens
caggcacgggagcucaggugag

SEQ ID NO: 1813 - RNA, 22 nt, Homo sapiens
cucaccugagcucccgugccug

SEQ ID NO: 1814 - RNA, 21 nt, Homo sapiens
ugaguguugucuacgagggca

SEQ ID NO: 1815 - RNA, 21 nt, Homo sapiens
ugcccucguagacaacacuca

SEQ ID NO: 1816 - RNA, 21 nt, Homo sapiens
acugacaggagagcauuuuga

SEQ ID NO: 1817 - RNA, 21 nt, Homo sapiens
ucaaaaugcucuccugucagu

SEQ ID NO: 1818 - RNA, 22 nt, Homo sapiens
ugaccugggacucggacagcug

SEQ ID NO: 1819 - RNA, 22 nt, Homo sapiens
cagcuguccgagucccagguca

SEQ ID NO: 1820 - RNA, 22 nt, Homo sapiens
ucucaggaguaaagacagaguu

SEQ ID NO: 1821 - RNA, 22 nt, Homo sapiens
aacucugucuuuacuccugaga

SEQ ID NO: 1822 - RNA, 22 nt, Homo sapiens
aacucugucuucacucaugagu

SEQ ID NO: 1823 - RNA, 22 nt, Homo sapiens
acucaugagugaagacagaguu

SEQ ID NO: 1824 - RNA, 22 nt, Homo sapiens
uggggcggagcuuccggaggcc

SEQ ID NO: 1825 - RNA, 22 nt, Homo sapiens
ggccuccggaagcuccgcccca

SEQ ID NO: 1826 - RNA, 22 nt, Homo sapiens
caaucagcaaguauacugcccu

SEQ ID NO: 1827 - RNA, 22 nt, Homo sapiens
agggcaguauacuugcugauug

SEQ ID NO: 1828 - RNA, 22 nt, Homo sapiens
uggcagugucuuagcugguugu

SEQ ID NO: 1829 - RNA, 22 nt, Homo sapiens
acaaccagcuaagacacugcca

SEQ ID NO: 1830 - RNA, 22 nt, Homo sapiens
ccaauauuggcugugcugcucc

SEQ ID NO: 1831 - RNA, 22 nt, Homo sapiens
ggagcagcacagccaauauugg

SEQ ID NO: 1832 - RNA, 21 nt, Homo sapiens
uagcagcacagaaauauuggc

SEQ ID NO: 1833 - RNA, 21 nt, Homo sapiens
gccaauauuucugugcugcua

SEQ ID NO: 1834 - RNA, 21 nt, Homo sapiens
uaauuuuauguauaagcuagu

SEQ ID NO: 1835 - RNA, 21 nt, Homo sapiens
acuagcuuauacauaaaauua

SEQ ID NO: 1836 - RNA, 22 nt, Homo sapiens
gagcuuauucauaaaagugcag

SEQ ID NO: 1837 - RNA, 22 nt, Homo sapiens
cugcacuuuuaugaauaagcuc

SEQ ID NO: 1838 - RNA, 22 nt, Homo sapiens
aagacgggaggaaagaagggag

SEQ ID NO: 1839 - RNA, 22 nt, Homo sapiens
cucccuucuuuccucccgucuu

SEQ ID NO: 1840 - RNA, 22 nt, Homo sapiens
cagugguuuuacccuaugguag

SEQ ID NO: 1841 - RNA, 22 nt, Homo sapiens
cuaccauaggguaaaaccacug

SEQ ID NO: 1842 - RNA, 22 nt, Homo sapiens
auucuaauuucuccacgucuuu

SEQ ID NO: 1843 - RNA, 22 nt, Homo sapiens
aaagacguggagaaauuagaau

SEQ ID NO: 1844 - RNA, 22 nt, Homo sapiens
aaccagcaccccaacuuuggac

SEQ ID NO: 1845 - RNA, 22 nt, Homo sapiens
guccaaaguuggggugcugguu

SEQ ID NO: 1846 - RNA, 24 nt, Homo sapiens
aaagacauaggauagagucaccuc

SEQ ID NO: 1847 - RNA, 24 nt, Homo sapiens
gaggugacucuauccuaugucuuu

SEQ ID NO: 1848 - RNA, 22 nt, Homo sapiens
uaacugguugaacaacugaacc

SEQ ID NO: 1849 - RNA, 22 nt, Homo sapiens
gguucaguuguucaaccaguua

SEQ ID NO: 1850 - RNA, 20 nt, Homo sapiens
cgugccacccuuuuccccag

SEQ ID NO: 1851 - RNA, 20 nt, Homo sapiens
cuggggaaaaggguggcacg

SEQ ID NO: 1852 - RNA, 17 nt, Homo sapiens
guggggccaggcggugg

SEQ ID NO: 1853 - RNA, 17 nt, Homo sapiens
ccaccgccuggccccac

SEQ ID NO: 1854 - RNA, 22 nt, Homo sapiens
aaaagcuggguugagagggcaa

SEQ ID NO: 1855 - RNA, 22 nt, Homo sapiens
uugcccucucaacccagcuuuu

SEQ ID NO: 1856 - RNA, 22 nt, Homo sapiens
gguccagaggggagauagguuc

SEQ ID NO: 1857 - RNA, 22 nt, Homo sapiens
gaaccuaucuccccucuggacc

SEQ ID NO: 1858 - RNA, 23 nt, Homo sapiens
uagccuucagaucuugguguuuu

SEQ ID NO: 1859 - RNA, 23 nt, Homo sapiens
aaaacaccaagaucugaaggcua

SEQ ID NO: 1860 - RNA, 23 nt, Homo sapiens
ccacuuggaucugaaggcugccc

SEQ ID NO: 1861 - RNA, 23 nt, Homo sapiens
gggcagccuucagauccaagugg

SEQ ID NO: 1862 - RNA, 22 nt, Homo sapiens
ugugcgcagggagaccucuccc

SEQ ID NO: 1863 - RNA, 22 nt, Homo sapiens
gggagaggucucccugcgcaca

SEQ ID NO: 1864 - RNA, 22 nt, Homo sapiens
ugucuacuacuggagacacugg

SEQ ID NO: 1865 - RNA, 22 nt, Homo sapiens
ccagugucuccaguaguagaca

SEQ ID NO: 1866 - RNA, 21 nt, Homo sapiens
aaggcagggcccccgcucccc

SEQ ID NO: 1867 - RNA, 21 nt, Homo sapiens
ggggagcgggggcccugccuu

SEQ ID NO: 1868 - RNA, 21 nt, Homo sapiens
cugacuguugccguccuccag

SEQ ID NO: 1869 - RNA, 21 nt, Homo sapiens
cuggaggacggcaacagucag

SEQ ID NO: 1870 - RNA, 25 nt, Homo sapiens
aaaaaccacaauuacuuuugcacca

SEQ ID NO: 1871 - RNA, 25 nt, Homo sapiens
uggugcaaaaguaauugugguuuuu

SEQ ID NO: 1872 - RNA, 23 nt, Homo sapiens
caaaaaccgcaauuacuuuugca

SEQ ID NO: 1873 - RNA, 23 nt, Homo sapiens
ugcaaaaguaauugcgguuuuug

SEQ ID NO: 1874 - RNA, 22 nt, Homo sapiens
augugccugagggaguaagaca

SEQ ID NO: 1875 - RNA, 22 nt, Homo sapiens
ugucuuacucccucaggcacau

SEQ ID NO: 1876 - RNA, 20 nt, Homo sapiens
ucuuacucccucaggcacug

SEQ ID NO: 1877 - RNA, 20 nt, Homo sapiens
cagugccugagggaguaaga

SEQ ID NO: 1878 - RNA, 22 nt, Homo sapiens
agacacauuuggagagggaccc

SEQ ID NO: 1879 - RNA, 22 nt, Homo sapiens
gggucccucuccaaaugugucu

SEQ ID NO: 1880 - RNA, 22 nt, Homo sapiens
gguucccucuccaaaugugucu

SEQ ID NO: 1881 - RNA, 22 nt, Homo sapiens
agacacauuuggagagggaacc

SEQ ID NO: 1882 - RNA, 21 nt, Homo sapiens
aaaauuucuuucacuacuuag

SEQ ID NO: 1883 - RNA, 21 nt, Homo sapiens
cuaaguagugaaagaaauuuu

SEQ ID NO: 1884 - RNA, 21 nt, Homo sapiens
uuagugaaggcuauuuuaauu

SEQ ID NO: 1885 - RNA, 21 nt, Homo sapiens
aauuaaaauagccuucacuaa

SEQ ID NO: 1886 - RNA, 20 nt, Homo sapiens
acuguaaacgcuuucugaug

SEQ ID NO: 1887 - RNA, 20 nt, Homo sapiens
caucagaaagcguuuacagu

SEQ ID NO: 1888 - RNA, 22 nt, Homo sapiens
gcaugugaugaagcaaaucagu

SEQ ID NO: 1889 - RNA, 22 nt, Homo sapiens
acugauuugcuucaucacaugc

SEQ ID NO: 1890 - RNA, 24 nt, Homo sapiens
caaagugaugaguaauacuggcug

SEQ ID NO: 1891 - RNA, 24 nt, Homo sapiens
cagccaguauuacucaucacuuug

SEQ ID NO: 1892 - RNA, 20 nt, Homo sapiens
gaaucggaaaggaggcgccg

SEQ ID NO: 1893 - RNA, 20 nt, Homo sapiens
cggcgccuccuuuccgauuc

SEQ ID NO: 1894 - RNA, 21 nt, Homo sapiens
uugugaagaaagaaauucuua

SEQ ID NO: 1895 - RNA, 21 nt, Homo sapiens
uaagaauuucuuucuucacaa

SEQ ID NO: 1896 - RNA, 22 nt, Homo sapiens
aggaggcaucuugagaaaugga

SEQ ID NO: 1897 - RNA, 22 nt, Homo sapiens
uccauuucucaagaugccuccu

SEQ ID NO: 1898 - RNA, 24 nt, Homo sapiens
acaaaaaaaaaagcccaacccuuc

SEQ ID NO: 1899 - RNA, 24 nt, Homo sapiens
gaaggguugggcuuuuuuuuuugu

SEQ ID NO: 1900 - RNA, 22 nt, Homo sapiens
uguuguacuuuuuuuuuuguuc

SEQ ID NO: 1901 - RNA, 22 nt, Homo sapiens
gaacaaaaaaaaaaguacaaca

SEQ ID NO: 1902 - RNA, 21 nt, Homo sapiens
ucucucggcuccucgcggcuc

SEQ ID NO: 1903 - RNA, 21 nt, Homo sapiens
gagccgcgaggagccgagaga

SEQ ID NO: 1904 - RNA, 23 nt, Homo sapiens
cgagggcauuucaugaugcaggc

SEQ ID NO: 1905 - RNA, 23 nt, Homo sapiens
gccugcaucaugaaaugcccucg

SEQ ID NO: 1906 - RNA, 22 nt, Homo sapiens
augaagugcacucaugauaugu

SEQ ID NO: 1907 - RNA, 22 nt, Homo sapiens
acauaucaugagugcacuucau

SEQ ID NO: 1908 - RNA, 22 nt, Homo sapiens
ugucuacauuaaugaaaagagc

SEQ ID NO: 1909 - RNA, 22 nt, Homo sapiens
gcucuuuucauuaauguagaca

SEQ ID NO: 1910 - RNA, 22 nt, Homo sapiens
ucacccugcaucccgcacccag

SEQ ID NO: 1911 - RNA, 22 nt, Homo sapiens
cugggugcgggaugcaggguga

SEQ ID NO: 1912 - RNA, 22 nt, Homo sapiens
gugggcugggcugggcugggcc

SEQ ID NO: 1913 - RNA, 22 nt, Homo sapiens
ggcccagcccagcccagcccac

SEQ ID NO: 1914 - RNA, 20 nt, Homo sapiens
cgcgggucggggucugcagg

SEQ ID NO: 1915 - RNA, 20 nt, Homo sapiens
ccugcagaccccgacccgcg

SEQ ID NO: 1916 - RNA, 21 nt, Homo sapiens
ucaccugagcucccgugccug

SEQ ID NO: 1917 - RNA, 21 nt, Homo sapiens
caggcacgggagcucagguga

SEQ ID NO: 1918 - RNA, 20 nt, Homo sapiens
aggcaugggaggucagguga

SEQ ID NO: 1919 - RNA, 20 nt, Homo sapiens
ucaccugaccucccaugccu

SEQ ID NO: 1920 - RNA, 23 nt, Homo sapiens
caucagcacccuauguccuuucu

SEQ ID NO: 1921 - RNA, 23 nt, Homo sapiens
agaaaggacauagggugcugaug

SEQ ID NO: 1922 - RNA, 22 nt, Homo sapiens
aaagacauaguugcaagauggg

SEQ ID NO: 1923 - RNA, 22 nt, Homo sapiens
cccaucuugcaacuaugucuuu

SEQ ID NO: 1924 - RNA, 22 nt, Homo sapiens
uuugugaccugguccacuaacc

SEQ ID NO: 1925 - RNA, 22 nt, Homo sapiens
gguuaguggaccaggucacaaa

SEQ ID NO: 1926 - RNA, 22 nt, Homo sapiens
gaugguugaccagagagcacac

SEQ ID NO: 1927 - RNA, 22 nt, Homo sapiens
gugugcucucuggucaaccauc

SEQ ID NO: 1928 - RNA, 20 nt, Homo sapiens
aaaagcuggguugagagggu

SEQ ID NO: 1929 - RNA, 20 nt, Homo sapiens
acccucucaacccagcuuuu

SEQ ID NO: 1930 - RNA, 21 nt, Homo sapiens
cacaagguauugguauuaccu

SEQ ID NO: 1931 - RNA, 21 nt, Homo sapiens
agguaauaccaauaccuugug

SEQ ID NO: 1932 - RNA, 22 nt, Homo sapiens
uaguaccaguaccuuguguuca

SEQ ID NO: 1933 - RNA, 22 nt, Homo sapiens
ugaacacaagguacugguacua

SEQ ID NO: 1934 - RNA, 22 nt, Homo sapiens
aguauucuguaccagggaaggu

SEQ ID NO: 1935 - RNA, 22 nt, Homo sapiens
accuucccugguacagaauacu

SEQ ID NO: 1936 - RNA, 22 nt, Homo sapiens
uggcaguguauuguuagcuggu

SEQ ID NO: 1937 - RNA, 22 nt, Homo sapiens
accagcuaacaauacacugcca

SEQ ID NO: 1938 - RNA, 22 nt, Homo sapiens
uauacaagggcaagcucucugu

SEQ ID NO: 1939 - RNA, 22 nt, Homo sapiens
acagagagcuugcccuuguaua

SEQ ID NO: 1940 - RNA, 22 nt, Homo sapiens
agcgagguugcccuuuguauau

SEQ ID NO: 1941 - RNA, 22 nt, Homo sapiens
auauacaaagggcaaccucgcu

SEQ ID NO: 1942 - RNA, 22 nt, Homo sapiens
caaucacuaacuccacugccau

SEQ ID NO: 1943 - RNA, 22 nt, Homo sapiens
auggcaguggaguuagugauug

SEQ ID NO: 1944 - RNA, 23 nt, Homo sapiens
uaggcagugucauuagcugauug

SEQ ID NO: 1945 - RNA, 23 nt, Homo sapiens
caaucagcuaaugacacugccua

SEQ ID NO: 1946 - RNA, 22 nt, Homo sapiens
cagccacaacuacccugccacu

SEQ ID NO: 1947 - RNA, 22 nt, Homo sapiens
aguggcaggguaguuguggcug

SEQ ID NO: 1948 - RNA, 22 nt, Homo sapiens
aggcaguguauuguuagcuggc

SEQ ID NO: 1949 - RNA, 22 nt, Homo sapiens
gccagcuaacaauacacugccu

SEQ ID NO: 1950 - RNA, 22 nt, Homo sapiens
aaucacuaaccacacggccagg

SEQ ID NO: 1951 - RNA, 22 nt, Homo sapiens
ccuggccgugugguuagugauu

SEQ ID NO: 1952 - RNA, 23 nt, Homo sapiens
aggcaguguaguuagcugauugc

SEQ ID NO: 1953 - RNA, 23 nt, Homo sapiens
gcaaucagcuaacuacacugccu

SEQ ID NO: 1954 - RNA, 20 nt, Homo sapiens
guccgcucggcgguggccca

SEQ ID NO: 1955 - RNA, 20 nt, Homo sapiens
ugggccaccgccgagcggac

SEQ ID NO: 1956 - RNA, 23 nt, Homo sapiens
gaacgccuguucuugccaggugg

SEQ ID NO: 1957 - RNA, 23 nt, Homo sapiens
ccaccuggcaagaacaggcguuc

SEQ ID NO: 1958 - RNA, 19 nt, Homo sapiens
aagugugcagggcacuggu

SEQ ID NO: 1959 - RNA, 19 nt, Homo sapiens
accagugcccugcacacuu

SEQ ID NO: 1960 - RNA, 21 nt, Homo sapiens
aggggugcuaucugugauuga

SEQ ID NO: 1961 - RNA, 21 nt, Homo sapiens
ucaaucacagauagcaccccu

SEQ ID NO: 1962 - RNA, 22 nt, Homo sapiens
cuuucagucagauguuugcugc

SEQ ID NO: 1963 - RNA, 22 nt, Homo sapiens
gcagcaaacaucugacugaaag

SEQ ID NO: 1964 - RNA, 22 nt, Homo sapiens
uguaaacauccccgacuggaag

SEQ ID NO: 1965 - RNA, 22 nt, Homo sapiens
cuuccagucggggauguuuaca

SEQ ID NO: 1966 - RNA, 22 nt, Homo sapiens
uguaaacauccucgacuggaag

SEQ ID NO: 1967 - RNA, 22 nt, Homo sapiens
cuuccagucgaggauguuuaca

SEQ ID NO: 1968 - RNA, 22 nt, Homo sapiens
agaaguaauugcgguuuugcca

SEQ ID NO: 1969 - RNA, 22 nt, Homo sapiens
uggcaaaaccgcaauuacuucu

SEQ ID NO: 1970 - RNA, 22 nt, Homo sapiens
caaaacuggcaauuacuuuugc

SEQ ID NO: 1971 - RNA, 22 nt, Homo sapiens
gcaaaaguaauugccaguuuug

SEQ ID NO: 1972 - RNA, 22 nt, Homo sapiens
aaaaguaauugcgaguuuuacc

SEQ ID NO: 1973 - RNA, 22 nt, Homo sapiens
gguaaaacucgcaauuacuuuu

SEQ ID NO: 1974 - RNA, 22 nt, Homo sapiens
caagaaccucaguugcuuuugu

SEQ ID NO: 1975 - RNA, 22 nt, Homo sapiens
acaaaagcaacugagguucuug

SEQ ID NO: 1976 - RNA, 22 nt, Homo sapiens
caaaaaucucaauuacuuuugc

SEQ ID NO: 1977 - RNA, 22 nt, Homo sapiens
gcaaaaguaauugagauuuuug

SEQ ID NO: 1978 - RNA, 22 nt, Homo sapiens
caaaaaccacaguuucuuuugc

SEQ ID NO: 1979 - RNA, 22 nt, Homo sapiens
gcaaaagaaacugugguuuuug

SEQ ID NO: 1980 - RNA, 22 nt, Homo sapiens
aaaaguaauugugguuuuugcc

SEQ ID NO: 1981 - RNA, 22 nt, Homo sapiens
ggcaaaaaccacaauuacuuuu

SEQ ID NO: 1982 - RNA, 21 nt, Homo sapiens
ugacaacuauggaugagcucu

SEQ ID NO: 1983 - RNA, 21 nt, Homo sapiens
agagcucauccauaguuguca

SEQ ID NO: 1984 - RNA, 21 nt, Homo sapiens
aacaggugacugguuagacaa

SEQ ID NO: 1985 - RNA, 21 nt, Homo sapiens
uugucuaaccagucaccuguu

SEQ ID NO: 1986 - RNA, 21 nt, Homo sapiens
aaaacggugagauuuuguuuu

SEQ ID NO: 1987 - RNA, 21 nt, Homo sapiens
aaaacaaaaucucaccguuuu

SEQ ID NO: 1988 - RNA, 21 nt, Homo sapiens
gcuaguccugacucagccagu

SEQ ID NO: 1989 - RNA, 21 nt, Homo sapiens
acuggcugagucaggacuagc

SEQ ID NO: 1990 - RNA, 21 nt, Homo sapiens
aggguaagcugaaccucugau

SEQ ID NO: 1991 - RNA, 21 nt, Homo sapiens
aucagagguucagcuuacccu

SEQ ID NO: 1992 - RNA, 22 nt, Homo sapiens
auauuaccauuagcucaucuuu

SEQ ID NO: 1993 - RNA, 22 nt, Homo sapiens
aaagaugagcuaaugguaauau

SEQ ID NO: 1994 - RNA, 22 nt, Homo sapiens
gaugagcucauuguaauaugag

SEQ ID NO: 1995 - RNA, 22 nt, Homo sapiens
cucauauuacaaugagcucauc

SEQ ID NO: 1996 - RNA, 19 nt, Homo sapiens
agguugacauacguuuccc

SEQ ID NO: 1997 - RNA, 19 nt, Homo sapiens
gggaaacguaugucaaccu

SEQ ID NO: 1998 - RNA, 20 nt, Homo sapiens
auguauaaauguauacacac

SEQ ID NO: 1999 - RNA, 20 nt, Homo sapiens
guguguauacauuuauacau

SEQ ID NO: 2000 - RNA, 24 nt, Homo sapiens
cugaagugauguguaacugaucag

SEQ ID NO: 2001 - RNA, 24 nt, Homo sapiens
cugaucaguuacacaucacuucag

SEQ ID NO: 2002 - RNA, 22 nt, Homo sapiens
aagauguggaaaaauuggaauc

SEQ ID NO: 2003 - RNA, 22 nt, Homo sapiens
gauuccaauuuuuccacaucuu

SEQ ID NO: 2004 - RNA, 21 nt, Homo sapiens
uagauaaaauauugguaccug

SEQ ID NO: 2005 - RNA, 21 nt, Homo sapiens
cagguaccaauauuuuaucua

SEQ ID NO: 2006 - RNA, 21 nt, Homo sapiens
cuucuugugcucuaggauugu

SEQ ID NO: 2007 - RNA, 21 nt, Homo sapiens
acaauccuagagcacaagaag

SEQ ID NO: 2008 - RNA, 22 nt, Homo sapiens
uaugcauuguauuuuuaggucc

SEQ ID NO: 2009 - RNA, 22 nt, Homo sapiens
ggaccuaaaaauacaaugcaua

SEQ ID NO: 2010 - RNA, 21 nt, Homo sapiens
uuuccauaggugaugagucac

SEQ ID NO: 2011 - RNA, 21 nt, Homo sapiens
gugacucaucaccuauggaaa

SEQ ID NO: 2012 - RNA, 21 nt, Homo sapiens
uuggccacaauggguuagaac

SEQ ID NO: 2013 - RNA, 21 nt, Homo sapiens
guucuaacccauuguggccaa

SEQ ID NO: 2014 - RNA, 22 nt, Homo sapiens
ugugucacucgaugaccacugu

SEQ ID NO: 2015 - RNA, 22 nt, Homo sapiens
acaguggucaucgagugacaca

SEQ ID NO: 2016 - RNA, 23 nt, Homo sapiens
acuuacagacaagagccuugcuc

SEQ ID NO: 2017 - RNA, 23 nt, Homo sapiens
gagcaaggcucuugucuguaagu

SEQ ID NO: 2018 - RNA, 19 nt, Homo sapiens
aggcugcggaauucaggac

SEQ ID NO: 2019 - RNA, 19 nt, Homo sapiens
guccugaauuccgcagccu

SEQ ID NO: 2020 - RNA, 23 nt, Homo sapiens
uaaaucccauggugccuucuccu

SEQ ID NO: 2021 - RNA, 23 nt, Homo sapiens
aggagaaggcaccaugggauuua

SEQ ID NO: 2022 - RNA, 21 nt, Homo sapiens
aaacuacugaaaaucaaagau

SEQ ID NO: 2023 - RNA, 21 nt, Homo sapiens
aucuuugauuuucaguaguuu

SEQ ID NO: 2024 - RNA, 21 nt, Homo sapiens
guucaaauccagaucuauaac

SEQ ID NO: 2025 - RNA, 21 nt, Homo sapiens
guuauagaucuggauuugaac

SEQ ID NO: 2026 - RNA, 19 nt, Homo sapiens
ccgguuccagucccuggag

SEQ ID NO: 2027 - RNA, 19 nt, Homo sapiens
cuccagggacuggaaccgg

SEQ ID NO: 2028 - RNA, 20 nt, Homo sapiens
aggguguuucucucaucucu

SEQ ID NO: 2029 - RNA, 20 nt, Homo sapiens
agagaugagagaaacacccu

SEQ ID NO: 2030 - RNA, 24 nt, Homo sapiens
gaccuggacauguuugugcccagu

SEQ ID NO: 2031 - RNA, 24 nt, Homo sapiens
acugggcacaaacauguccagguc

SEQ ID NO: 2032 - RNA, 20 nt, Homo sapiens
auggagauagauauagaaau

SEQ ID NO: 2033 - RNA, 20 nt, Homo sapiens
auuucuauaucuaucuccau

SEQ ID NO: 2034 - RNA, 19 nt, Homo sapiens
agcugucugaaaaugucuu

SEQ ID NO: 2035 - RNA, 19 nt, Homo sapiens
aagacauuuucagacagcu

SEQ ID NO: 2036 - RNA, 21 nt, Homo sapiens
agaccuggcccagaccucagc

SEQ ID NO: 2037 - RNA, 21 nt, Homo sapiens
gcugaggucugggccaggucu

SEQ ID NO: 2038 - RNA, 23 nt, Homo sapiens
acuugggcacugaaacaaugucc

SEQ ID NO: 2039 - RNA, 23 nt, Homo sapiens
ggacauuguuucagugcccaagu

SEQ ID NO: 2040 - RNA, 24 nt, Homo sapiens
acugggggcuuucgggcucugcgu

SEQ ID NO: 2041 - RNA, 24 nt, Homo sapiens
acgcagagcccgaaagcccccagu

SEQ ID NO: 2042 - RNA, 23 nt, Homo sapiens
aucgcugcgguugcgagcgcugu

SEQ ID NO: 2043 - RNA, 23 nt, Homo sapiens
acagcgcucgcaaccgcagcgau

SEQ ID NO: 2044 - RNA, 22 nt, Homo sapiens
gucccucuccaaaugugucuug

SEQ ID NO: 2045 - RNA, 22 nt, Homo sapiens
caagacacauuuggagagggac

SEQ ID NO: 2046 - RNA, 22 nt, Homo sapiens
acuuguaugcuagcucagguag

SEQ ID NO: 2047 - RNA, 22 nt, Homo sapiens
cuaccugagcuagcauacaagu

SEQ ID NO: 2048 - RNA, 22 nt, Homo sapiens
uuuaggauaagcuugacuuuug

SEQ ID NO: 2049 - RNA, 22 nt, Homo sapiens
caaaagucaagcuuauccuaaa

SEQ ID NO: 2050 - RNA, 21 nt, Homo sapiens
guguugaaacaaucucuacug

SEQ ID NO: 2051 - RNA, 21 nt, Homo sapiens
caguagagauuguuucaacac

SEQ ID NO: 2052 - RNA, 22 nt, Homo sapiens
uaugucugcugaccaucaccuu

SEQ ID NO: 2053 - RNA, 22 nt, Homo sapiens
aaggugauggucagcagacaua

SEQ ID NO: 2054 - RNA, 22 nt, Homo sapiens
ggggcuggggccggggccgagc

SEQ ID NO: 2055 - RNA, 22 nt, Homo sapiens
gcucggccccggccccagcccc

SEQ ID NO: 2056 - RNA, 22 nt, Homo sapiens
ugagguaguagguuguaugguu

SEQ ID NO: 2057 - RNA, 22 nt, Homo sapiens
aaccauacaaccuacuaccuca

SEQ ID NO: 2058 - RNA, 21 nt, Homo sapiens
gugucuuuugcucugcaguca

SEQ ID NO: 2059 - RNA, 21 nt, Homo sapiens
ugacugcagagcaaaagacac

SEQ ID NO: 2060 - RNA, 24 nt, Homo sapiens
ccccgggaacgucgagacuggagc

SEQ ID NO: 2061 - RNA, 24 nt, Homo sapiens
gcuccagucucgacguucccgggg

SEQ ID NO: 2062 - RNA, 22 nt, Homo sapiens
acccgucccguucguccccgga

SEQ ID NO: 2063 - RNA, 22 nt, Homo sapiens
uccggggacgaacgggacgggu

SEQ ID NO: 2064 - RNA, 22 nt, Homo sapiens
augggugaauuuguagaaggau

SEQ ID NO: 2065 - RNA, 22 nt, Homo sapiens
auccuucuacaaauucacccau

SEQ ID NO: 2066 - RNA, 22 nt, Homo sapiens
cuggacugagccgugcuacugg

SEQ ID NO: 2067 - RNA, 22 nt, Homo sapiens
ccaguagcacggcucaguccag

SEQ ID NO: 2068 - RNA, 22 nt, Homo sapiens
cuggacugagccaugcuacugg

SEQ ID NO: 2069 - RNA, 22 nt, Homo sapiens
ccaguagcauggcucaguccag

SEQ ID NO: 2070 - RNA, 22 nt, Homo sapiens
uacguagauauauauguauuuu

SEQ ID NO: 2071 - RNA, 22 nt, Homo sapiens
aaaauacauauauaucuacgua

SEQ ID NO: 2072 - RNA, 24 nt, Homo sapiens
aaauauauauauauauguacguau

SEQ ID NO: 2073 - RNA, 22 nt, Homo sapiens
gcucuuuucauuaauguagaca

SEQ ID NO: 2074 - RNA, 22 nt, Homo sapiens
ugcuggaucagugguucgaguc

SEQ ID NO: 2075 - RNA, 22 nt, Homo sapiens
gacucgaaccacugauccagca

SEQ ID NO: 2076 - RNA, 19 nt, Homo sapiens
uggauuuuuggaucaggga

SEQ ID NO: 2077 - RNA, 19 nt, Homo sapiens
ucccugauccaaaaaucca

SEQ ID NO: 2078 - RNA, 22 nt, Homo sapiens
uuauaaagcaaugagacugauu

SEQ ID NO: 2079 - RNA, 22 nt, Homo sapiens
aaucagucucauugcuuuauaa

SEQ ID NO: 2080 - RNA, 23 nt, Homo sapiens
uagugcaauauugcuuauagggu

SEQ ID NO: 2081 - RNA, 23 nt, Homo sapiens
acccuauaagcaauauugcacua

SEQ ID NO: 2082 - RNA, 22 nt, Homo sapiens
acccuaucaauauugucucugc

SEQ ID NO: 2083 - RNA, 22 nt, Homo sapiens
gcagagacaauauugauagggu

SEQ ID NO: 2084 - RNA, 17 nt, Homo sapiens
uaagugcuuccaugcuu

SEQ ID NO: 2085 - RNA, 17 nt, Homo sapiens
aagcauggaagcacuua

SEQ ID NO: 2086 - RNA, 22 nt, Homo sapiens
ucggccugaccacccaccccac

SEQ ID NO: 2087 - RNA, 22 nt, Homo sapiens
gugggguggguggucaggccga

SEQ ID NO: 2088 - RNA, 21 nt, Homo sapiens
ggggggggggggggggggccg

SEQ ID NO: 2089 - RNA, 21 nt, Homo sapiens
cggcccccccccccccccccc

SEQ ID NO: 2090 - RNA, 22 nt, Homo sapiens
cuauacgaccugcugccuuucu

SEQ ID NO: 2091 - RNA, 22 nt, Homo sapiens
agaaaggcagcaggucguauag

SEQ ID NO: 2092 - RNA, 22 nt, Homo sapiens
agagguaguagguugcauaguu

SEQ ID NO: 2093 - RNA, 22 nt, Homo sapiens
aacuaugcaaccuacuaccucu

SEQ ID NO: 2094 - RNA, 22 nt, Homo sapiens
ccgcacuguggguacuugcugc

SEQ ID NO: 2095 - RNA, 22 nt, Homo sapiens
gcagcaaguacccacagugcgg

SEQ ID NO: 2096 - RNA, 21 nt, Homo sapiens
uaaagugcugacagugcagau

SEQ ID NO: 2097 - RNA, 21 nt, Homo sapiens
aucugcacugucagcacuuua

SEQ ID NO: 2098 - RNA, 22 nt, Homo sapiens
aacuggaucaauuauaggagug

SEQ ID NO: 2099 - RNA, 22 nt, Homo sapiens
cacuccuauaauugauccaguu

SEQ ID NO: 2100 - RNA, 26 nt, Homo sapiens
aaguaguugguuuguaugagaugguu

SEQ ID NO: 2101 - RNA, 26 nt, Homo sapiens
aaccaucucauacaaaccaacuacuu

SEQ ID NO: 2102 - RNA, 21 nt, Homo sapiens
aagugaucuaaaggccuacau

SEQ ID NO: 2103 - RNA, 21 nt, Homo sapiens
auguaggccuuuagaucacuu

SEQ ID NO: 2104 - RNA, 22 nt, Homo sapiens
ucagaugaucuaaaggccuaua

SEQ ID NO: 2105 - RNA, 22 nt, Homo sapiens
uauaggccuuuagaucaucuga

SEQ ID NO: 2106 - RNA, 21 nt, Homo sapiens
uaggccuuuagaucacuuaaa

SEQ ID NO: 2107 - RNA, 21 nt, Homo sapiens
uuuaagugaucuaaaggccua

SEQ ID NO: 2108 - RNA, 21 nt, Homo sapiens
acucuagcugccaaaggcgcu

SEQ ID NO: 2109 - RNA, 21 nt, Homo sapiens
agcgccuuuggcagcuagagu

SEQ ID NO: 2110 - RNA, 22 nt, Homo sapiens
agaaggaaauugaauucauuua

SEQ ID NO: 2111 - RNA, 22 nt, Homo sapiens
uaaaugaauucaauuuccuucu

SEQ ID NO: 2112 - RNA, 21 nt, Homo sapiens
agagaagaagaucagccugca

SEQ ID NO: 2113 - RNA, 21 nt, Homo sapiens
ugcaggcugaucuucuucucu

SEQ ID NO: 2114 - RNA, 24 nt, Homo sapiens
agccuggaagcuggagccugcagu

SEQ ID NO: 2115 - RNA, 24 nt, Homo sapiens
acugcaggcuccagcuuccaggcu

SEQ ID NO: 2116 - RNA, 23 nt, Homo sapiens
aggaugagcaaagaaaguagauu

SEQ ID NO: 2117 - RNA, 23 nt, Homo sapiens
aaucuacuuucuuugcucauccu

SEQ ID NO: 2118 - RNA, 22 nt, Homo sapiens
aaccacuuucuuugcucaucca

SEQ ID NO: 2119 - RNA, 22 nt, Homo sapiens
uggaugagcaaagaaagugguu

SEQ ID NO: 2120 - RNA, 22 nt, Homo sapiens
cggaugagcaaagaaagugguu

SEQ ID NO: 2121 - RNA, 22 nt, Homo sapiens
aaccacuuucuuugcucauccg

SEQ ID NO: 2122 - RNA, 22 nt, Homo sapiens
aggcauugacuucucacuagcu

SEQ ID NO: 2123 - RNA, 22 nt, Homo sapiens
agcuagugagaagucaaugccu

SEQ ID NO: 2124 - RNA, 21 nt, Homo sapiens
agugaaugauggguucugacc

SEQ ID NO: 2125 - RNA, 21 nt, Homo sapiens
ggucagaacccaucauucacu

SEQ ID NO: 2126 - RNA, 21 nt, Homo sapiens
aguuaggauuaggucguggaa

SEQ ID NO: 2127 - RNA, 21 nt, Homo sapiens
uuccacgaccuaauccuaacu

SEQ ID NO: 2128 - RNA, 19 nt, Homo sapiens
auggauaaggcuuuggcuu

SEQ ID NO: 2129 - RNA, 19 nt, Homo sapiens
aagccaaagccuuauccau

SEQ ID NO: 2130 - RNA, 22 nt, Homo sapiens
augguacccuggcauacugagu

SEQ ID NO: 2131 - RNA, 22 nt, Homo sapiens
acucaguaugccaggguaccau

SEQ ID NO: 2132 - RNA, 23 nt, Homo sapiens
caagucuuauuugagcaccuguu

SEQ ID NO: 2133 - RNA, 23 nt, Homo sapiens
aacaggugcucaaauaagacuug

SEQ ID NO: 2134 - RNA, 22 nt, Homo sapiens
caggauguggucaaguguuguu

SEQ ID NO: 2135 - RNA, 22 nt, Homo sapiens
aacaacacuugaccacauccug

SEQ ID NO: 2136 - RNA, 23 nt, Homo sapiens
ccucagggcuguagaacagggcu

SEQ ID NO: 2137 - RNA, 23 nt, Homo sapiens
agcccuguucuacagcccugagg

SEQ ID NO: 2138 - RNA, 21 nt, Homo sapiens
ccuguugaaguguaaucccca

SEQ ID NO: 2139 - RNA, 21 nt, Homo sapiens
uggggauuacacuucaacagg

SEQ ID NO: 2140 - RNA, 18 nt, Homo sapiens
cgggcguggugguggggg

SEQ ID NO: 2141 - RNA, 18 nt, Homo sapiens
cccccaccaccacgcccg

SEQ ID NO: 2142 - RNA, 20 nt, Homo sapiens
cgggcgugguggugggggug

SEQ ID NO: 2143 - RNA, 20 nt, Homo sapiens
cacccccaccaccacgcccg

SEQ ID NO: 2144 - RNA, 23 nt, Homo sapiens
cuggagauauggaagagcugugu

SEQ ID NO: 2145 - RNA, 23 nt, Homo sapiens
acacagcucuuccauaucuccag

SEQ ID NO: 2146 - RNA, 26 nt, Homo sapiens
gaugaugauggcagcaaauucugaaa

SEQ ID NO: 2147 - RNA, 26 nt, Homo sapiens
uuucagaauuugcugccaucaucauc

SEQ ID NO: 2148 - RNA, 25 nt, Homo sapiens
gggcgacaaagcaagacucuuucuu

SEQ ID NO: 2149 - RNA, 25 nt, Homo sapiens
aagaaagagucuugcuuugucgccc

SEQ ID NO: 2150 - RNA, 25 nt, Homo sapiens
gaacccaugagguugaggcugcagu

SEQ ID NO: 2151 - RNA, 25 nt, Homo sapiens
acugcagccucaaccucauggguuc

SEQ ID NO: 2152 - RNA, 17 nt, Homo sapiens
gugggggagaggcuguc

SEQ ID NO: 2153 - RNA, 17 nt, Homo sapiens
gacagccucucccccac

SEQ ID NO: 2154 - RNA, 20 nt, Homo sapiens
uaaagagcccuguggagaca

SEQ ID NO: 2155 - RNA, 20 nt, Homo sapiens
ugucuccacagggcucuuua

SEQ ID NO: 2156 - RNA, 22 nt, Homo sapiens
uaguacugugcauaucaucuau

SEQ ID NO: 2157 - RNA, 22 nt, Homo sapiens
auagaugauaugcacaguacua

SEQ ID NO: 2158 - RNA, 20 nt, Homo sapiens
ucguuugccuuuuucugcuu

SEQ ID NO: 2159 - RNA, 20 nt, Homo sapiens
aagcagaaaaaggcaaacga

SEQ ID NO: 2160 - RNA, 21 nt, Homo sapiens
uggacugcccugaucuggaga

SEQ ID NO: 2161 - RNA, 21 nt, Homo sapiens
ucuccagaucagggcagucca

SEQ ID NO: 2162 - RNA, 22 nt, Homo sapiens
uggguggucuggagauuugugc

SEQ ID NO: 2163 - RNA, 22 nt, Homo sapiens
gcacaaaucuccagaccaccca

SEQ ID NO: 2164 - RNA, 22 nt, Homo sapiens
ugugagguuggcauuguugucu

SEQ ID NO: 2165 - RNA, 22 nt, Homo sapiens
agacaacaaugccaaccucaca

SEQ ID NO: 2166 - RNA, 17 nt, Homo sapiens
uucaaguaauucaggug

SEQ ID NO: 2167 - RNA, 17 nt, Homo sapiens
caccugaauuacuugaa

SEQ ID NO: 2168 - RNA, 22 nt, Homo sapiens
uucuggaauucugugugaggga

SEQ ID NO: 2169 - RNA, 22 nt, Homo sapiens
ucccucacacagaauuccagaa

SEQ ID NO: 2170 - RNA, 22 nt, Homo sapiens
uuuucaacucuaaugggagaga

SEQ ID NO: 2171 - RNA, 22 nt, Homo sapiens
ucucucccauuagaguugaaaa

SEQ ID NO: 2172 - RNA, 18 nt, Homo sapiens
acguuggcucugguggug

SEQ ID NO: 2173 - RNA, 18 nt, Homo sapiens
caccaccagagccaacgu

SEQ ID NO: 2174 - RNA, 22 nt, Homo sapiens
ccaccuccccugcaaacgucca

SEQ ID NO: 2175 - RNA, 22 nt, Homo sapiens
uggacguuugcaggggaggugg

SEQ ID NO: 2176 - RNA, 22 nt, Homo sapiens
acucggcguggcgucggucgug

SEQ ID NO: 2177 - RNA, 22 nt, Homo sapiens
cacgaccgacgccacgccgagu

SEQ ID NO: 2178 - RNA, 21 nt, Homo sapiens
ucgaccggaccucgaccggcu

SEQ ID NO: 2179 - RNA, 21 nt, Homo sapiens
agccggucgagguccggucga

SEQ ID NO: 2180 - RNA, 22 nt, Homo sapiens
ugagaacugaauuccauaggcu

SEQ ID NO: 2181 - RNA, 22 nt, Homo sapiens
agccuauggaauucaguucuca

SEQ ID NO: 2182 - RNA, 22 nt, Homo sapiens
aaucauacacgguugaccuauu

SEQ ID NO: 2183 - RNA, 22 nt, Homo sapiens
aauaggucaaccguguaugauu

SEQ ID NO: 2184 - RNA, 22 nt, Homo sapiens
uagguuauccguguugccuucg

SEQ ID NO: 2185 - RNA, 22 nt, Homo sapiens
cgaaggcaacacggauaaccua

SEQ ID NO: 2186 - RNA, 21 nt, Homo sapiens
ccaguccugugccugccgccu

SEQ ID NO: 2187 - RNA, 21 nt, Homo sapiens
aggcggcaggcacaggacugg

SEQ ID NO: 2188 - RNA, 22 nt, Homo sapiens
ucugcccccuccgcugcugcca

SEQ ID NO: 2189 - RNA, 22 nt, Homo sapiens
uggcagcagcggagggggcaga

SEQ ID NO: 2190 - RNA, 22 nt, Homo sapiens
ggaggggucccgcacugggagg

SEQ ID NO: 2191 - RNA, 22 nt, Homo sapiens
ccucccagugcgggaccccucc

SEQ ID NO: 2192 - RNA, 22 nt, Homo sapiens
cccugugcccggcccacuucug

SEQ ID NO: 2193 - RNA, 22 nt, Homo sapiens
cagaagugggccgggcacaggg

SEQ ID NO: 2194 - RNA, 20 nt, Homo sapiens
ccccagggcgacgcggcggg

SEQ ID NO: 2195 - RNA, 20 nt, Homo sapiens
cccgccgcgucgcccugggg

SEQ ID NO: 2196 - RNA, 22 nt, Homo sapiens
accuugccuugcugcccgggcc

SEQ ID NO: 2197 - RNA, 22 nt, Homo sapiens
ggcccgggcagcaaggcaaggu

SEQ ID NO: 2198 - RNA, 21 nt, Homo sapiens
auuugugcuuggcucugucac

SEQ ID NO: 2199 - RNA, 21 nt, Homo sapiens
gugacagagccaagcacaaau

SEQ ID NO: 2200 - RNA, 22 nt, Homo sapiens
auuguccuugcuguuuggagau

SEQ ID NO: 2201 - RNA, 22 nt, Homo sapiens
aucuccaaacagcaaggacaau

SEQ ID NO: 2202 - RNA, 21 nt, Homo sapiens
auccccagauacaauggacaa

SEQ ID NO: 2203 - RNA, 21 nt, Homo sapiens
uuguccauuguaucuggggau

SEQ ID NO: 2204 - RNA, 23 nt, Homo sapiens
cagugcaauaguauugucaaagc

SEQ ID NO: 2205 - RNA, 23 nt, Homo sapiens
gcuuugacaauacuauugcacug

SEQ ID NO: 2206 - RNA, 22 nt, Homo sapiens
gcucugacuuuauugcacuacu

SEQ ID NO: 2207 - RNA, 22 nt, Homo sapiens
aguagugcaauaaagucagagc

SEQ ID NO: 2208 - RNA, 23 nt, Homo sapiens
uaagugcuuccauguuuuaguag

SEQ ID NO: 2209 - RNA, 23 nt, Homo sapiens
cuacuaaaacauggaagcacuua

SEQ ID NO: 2210 - RNA, 22 nt, Homo sapiens
acuuuaacauggaagugcuuuc

SEQ ID NO: 2211 - RNA, 22 nt, Homo sapiens
gaaagcacuuccauguuaaagu

SEQ ID NO: 2212 - RNA, 23 nt, Homo sapiens
uaagugcuuccauguuucagugg

SEQ ID NO: 2213 - RNA, 23 nt, Homo sapiens
ccacugaaacauggaagcacuua

SEQ ID NO: 2214 - RNA, 22 nt, Homo sapiens
uuuaacauggggguaccugcug

SEQ ID NO: 2215 - RNA, 22 nt, Homo sapiens
cagcagguacccccauguuaaa

SEQ ID NO: 2216 - RNA, 23 nt, Homo sapiens
uaagugcuuccauguuugagugu

SEQ ID NO: 2217 - RNA, 23 nt, Homo sapiens
acacucaaacauggaagcacuua

SEQ ID NO: 2218 - RNA, 22 nt, Homo sapiens
acuuuaacauggaggcacuugc

SEQ ID NO: 2219 - RNA, 22 nt, Homo sapiens
gcaagugccuccauguuaaagu

SEQ ID NO: 2220 - RNA, 22 nt, Homo sapiens
aauugcacuuuagcaaugguga

SEQ ID NO: 2221 - RNA, 22 nt, Homo sapiens
ucaccauugcuaaagugcaauu

SEQ ID NO: 2222 - RNA, 22 nt, Homo sapiens
acuguugcuaauaugcaacucu

SEQ ID NO: 2223 - RNA, 22 nt, Homo sapiens
agaguugcauauuagcaacagu

SEQ ID NO: 2224 - RNA, 23 nt, Homo sapiens
agcucggucugaggccccucagu

SEQ ID NO: 2225 - RNA, 23 nt, Homo sapiens
acugaggggccucagaccgagcu

SEQ ID NO: 2226 - RNA, 22 nt, Homo sapiens
aaaaacugagacuacuuuugca

SEQ ID NO: 2227 - RNA, 22 nt, Homo sapiens
ugcaaaaguagucucaguuuuu

SEQ ID NO: 2228 - RNA, 19 nt, Homo sapiens
aaaaacuguaauuacuuuu

SEQ ID NO: 2229 - RNA, 19 nt, Homo sapiens
aaaaguaauuacaguuuuu

SEQ ID NO: 2230 - RNA, 22 nt, Homo sapiens
aaaacuguaauuacuuuuguac

SEQ ID NO: 2231 - RNA, 22 nt, Homo sapiens
guacaaaaguaauuacaguuuu

SEQ ID NO: 2232 - RNA, 23 nt, Homo sapiens
ugcaaaaguaauugcaguuuuug

SEQ ID NO: 2233 - RNA, 23 nt, Homo sapiens
caaaaacugcaauuacuuuugca

SEQ ID NO: 2234 - RNA, 23 nt, Homo sapiens
caaaaaccgcaauuacuuuugca

SEQ ID NO: 2235 - RNA, 23 nt, Homo sapiens
ugcaaaaguaauugcgguuuuug

SEQ ID NO: 2236 - RNA, 22 nt, Homo sapiens
aaaaguaaucgcgguuuuuguc

SEQ ID NO: 2237 - RNA, 22 nt, Homo sapiens
gacaaaaaccgcgauuacuuuu

SEQ ID NO: 2238 - RNA, 22 nt, Homo sapiens
aaaaguacuugcggauuuugcu

SEQ ID NO: 2239 - RNA, 22 nt, Homo sapiens
agcaaaauccgcaaguacuuuu

SEQ ID NO: 2240 - RNA, 22 nt, Homo sapiens
aaaaguauuugcggguuuuguc

SEQ ID NO: 2241 - RNA, 22 nt, Homo sapiens
gacaaaacccgcaaauacuuuu

SEQ ID NO: 2242 - RNA, 21 nt, Homo sapiens
caaagguauuugugguuuuug

SEQ ID NO: 2243 - RNA, 21 nt, Homo sapiens
caaaaaccacaaauaccuuug

SEQ ID NO: 2244 - RNA, 22 nt, Homo sapiens
ccaaaacugcaguuacuuuugc

SEQ ID NO: 2245 - RNA, 22 nt, Homo sapiens
gcaaaaguaacugcaguuuugg

SEQ ID NO: 2246 - RNA, 22 nt, Homo sapiens
aaaaguaauugcgguuuuugcc

SEQ ID NO: 2247 - RNA, 22 nt, Homo sapiens
ggcaaaaaccgcaauuacuuuu

SEQ ID NO: 2248 - RNA, 22 nt, Homo sapiens
uagcaaaaacugcaguuacuuu

SEQ ID NO: 2249 - RNA, 22 nt, Homo sapiens
aaaguaacugcaguuuuugcua

SEQ ID NO: 2250 - RNA, 20 nt, Homo sapiens
ggagguugggaagggcagag

SEQ ID NO: 2251 - RNA, 20 nt, Homo sapiens
cucugcccuucccaaccucc

SEQ ID NO: 2252 - RNA, 18 nt, Homo sapiens
ugaggcgggggggcgagc

SEQ ID NO: 2253 - RNA, 18 nt, Homo sapiens
gcucgcccccccgccuca

SEQ ID NO: 2254 - RNA, 20 nt, Homo sapiens
agagaugaagcgggggggcg

SEQ ID NO: 2255 - RNA, 20 nt, Homo sapiens
cgcccccccgcuucaucucu

SEQ ID NO: 2256 - RNA, 24 nt, Homo sapiens
ggaggccgggguggggcggggcgg

SEQ ID NO: 2257 - RNA, 24 nt, Homo sapiens
ccgccccgccccaccccggccucc

SEQ ID NO: 2258 - RNA, 19 nt, Homo sapiens
ggggagcgaggggcggggc

SEQ ID NO: 2259 - RNA, 19 nt, Homo sapiens
gccccgccccucgcucccc

SEQ ID NO: 2260 - RNA, 23 nt, Homo sapiens
uauucauuuauccccagccuaca

SEQ ID NO: 2261 - RNA, 23 nt, Homo sapiens
uguaggcuggggauaaaugaaua

SEQ ID NO: 2262 - RNA, 24 nt, Homo sapiens
acuggcuagggaaaaugauuggau

SEQ ID NO: 2263 - RNA, 24 nt, Homo sapiens
auccaaucauuuucccuagccagu

SEQ ID NO: 2264 - RNA, 22 nt, Homo sapiens
uucauuugccucccagccuaca

SEQ ID NO: 2265 - RNA, 22 nt, Homo sapiens
uguaggcugggaggcaaaugaa

SEQ ID NO: 2266 - RNA, 24 nt, Homo sapiens
ugggcuaagggagaugauugggua

SEQ ID NO: 2267 - RNA, 24 nt, Homo sapiens
uacccaaucaucucccuuagccca

SEQ ID NO: 2268 - RNA, 22 nt, Homo sapiens
acuccagccccacagccucagc

SEQ ID NO: 2269 - RNA, 22 nt, Homo sapiens
gcugaggcuguggggcuggagu

SEQ ID NO: 2270 - RNA, 22 nt, Homo sapiens
aggaggaauuggugcuggucuu

SEQ ID NO: 2271 - RNA, 22 nt, Homo sapiens
aagaccagcaccaauuccuccu

SEQ ID NO: 2272 - RNA, 22 nt, Homo sapiens
aggcagcgggguguaguggaua

SEQ ID NO: 2273 - RNA, 22 nt, Homo sapiens
uauccacuacaccccgcugccu

SEQ ID NO: 2274 - RNA, 22 nt, Homo sapiens
uccauuacacuacccugccucu

SEQ ID NO: 2275 - RNA, 22 nt, Homo sapiens
agaggcaggguaguguaaugga

SEQ ID NO: 2276 - RNA, 22 nt, Homo sapiens
acugcugagcuagcacuucccg

SEQ ID NO: 2277 - RNA, 22 nt, Homo sapiens
cgggaagugcuagcucagcagu

SEQ ID NO: 2278 - RNA, 23 nt, Homo sapiens
caaagugcuguucgugcagguag

SEQ ID NO: 2279 - RNA, 23 nt, Homo sapiens
cuaccugcacgaacagcacuuug

SEQ ID NO: 2280 - RNA, 23 nt, Homo sapiens
cacccggcugugugcacaugugc

SEQ ID NO: 2281 - RNA, 23 nt, Homo sapiens
gcacaugugcacacagccgggug

SEQ ID NO: 2282 - RNA, 23 nt, Homo sapiens
agcuucuuuacagugcugccuug

SEQ ID NO: 2283 - RNA, 23 nt, Homo sapiens
caaggcagcacuguaaagaagcu

SEQ ID NO: 2284 - RNA, 23 nt, Homo sapiens
agcagcauuguacagggcuauga

SEQ ID NO: 2285 - RNA, 23 nt, Homo sapiens
ucauagcccuguacaaugcugcu

SEQ ID NO: 2286 - RNA, 17 nt, Homo sapiens
ccugagaaaagggccaa

SEQ ID NO: 2287 - RNA, 17 nt, Homo sapiens
uuggcccuuuucucagg

SEQ ID NO: 2288 - RNA, 19 nt, Homo sapiens
ggccacugagucagcacca

SEQ ID NO: 2289 - RNA, 19 nt, Homo sapiens
uggugcugacucaguggcc

SEQ ID NO: 2290 - RNA, 18 nt, Homo sapiens
agggcauguccagggggu

SEQ ID NO: 2291 - RNA, 18 nt, Homo sapiens
acccccuggacaugcccu

SEQ ID NO: 2292 - RNA, 23 nt, Homo sapiens
gccuggagcuacuccaccaucuc

SEQ ID NO: 2293 - RNA, 23 nt, Homo sapiens
gagaugguggaguagcuccaggc

SEQ ID NO: 2294 - RNA, 17 nt, Homo sapiens
caguguucagagaugga

SEQ ID NO: 2295 - RNA, 17 nt, Homo sapiens
uccaucucugaacacug

SEQ ID NO: 2296 - RNA, 18 nt, Homo sapiens
aucugaccugaugaaggu

SEQ ID NO: 2297 - RNA, 18 nt, Homo sapiens
accuucaucaggucagau

SEQ ID NO: 2298 - RNA, 18 nt, Homo sapiens
ccagagguggggacugag

SEQ ID NO: 2299 - RNA, 18 nt, Homo sapiens
cucaguccccaccucugg

SEQ ID NO: 2300 - RNA, 17 nt, Homo sapiens
ccccgccaccgccuugg

SEQ ID NO: 2301 - RNA, 17 nt, Homo sapiens
ccaaggcgguggcgggg

SEQ ID NO: 2302 - RNA, 22 nt, Homo sapiens
caguugggucuaggggucagga

SEQ ID NO: 2303 - RNA, 22 nt, Homo sapiens
uccugaccccuagacccaacug

SEQ ID NO: 2304 - RNA, 19 nt, Homo sapiens
cuuggggcauggaguccca

SEQ ID NO: 2305 - RNA, 19 nt, Homo sapiens
ugggacuccaugccccaag

SEQ ID NO: 2306 - RNA, 16 nt, Homo sapiens
aggaaacagggaccca

SEQ ID NO: 2307 - RNA, 16 nt, Homo sapiens
ugggucccuguuuccu

SEQ ID NO: 2308 - RNA, 17 nt, Homo sapiens
gacauucagacuaccug

SEQ ID NO: 2309 - RNA, 17 nt, Homo sapiens
cagguagucugaauguc

SEQ ID NO: 2310 - RNA, 18 nt, Homo sapiens
auucuaagugccuuggcc

SEQ ID NO: 2311 - RNA, 18 nt, Homo sapiens
ggccaaggcacuuagaau

SEQ ID NO: 2312 - RNA, 17 nt, Homo sapiens
acucagucauggucauu

SEQ ID NO: 2313 - RNA, 17 nt, Homo sapiens
aaugaccaugacugagu

SEQ ID NO: 2314 - RNA, 19 nt, Homo sapiens
cugugggcucagcucuggg

SEQ ID NO: 2315 - RNA, 19 nt, Homo sapiens
cccagagcugagcccacag

SEQ ID NO: 2316 - RNA, 16 nt, Homo sapiens
cuaggaggccuuggcc

SEQ ID NO: 2317 - RNA, 16 nt, Homo sapiens
ggccaaggccuccuag

SEQ ID NO: 2318 - RNA, 16 nt, Homo sapiens
uccagcucgguggcac

SEQ ID NO: 2319 - RNA, 16 nt, Homo sapiens
gugccaccgagcugga

SEQ ID NO: 2320 - RNA, 21 nt, Homo sapiens
ggcuccuccucucaggaugug

SEQ ID NO: 2321 - RNA, 21 nt, Homo sapiens
cacauccugagaggaggagcc

SEQ ID NO: 2322 - RNA, 21 nt, Homo sapiens
gcaggcacagacagcccuggc

SEQ ID NO: 2323 - RNA, 21 nt, Homo sapiens
gccagggcugucugugccugc

SEQ ID NO: 2324 - RNA, 20 nt, Homo sapiens
ucagggagucaggggagggc

SEQ ID NO: 2325 - RNA, 20 nt, Homo sapiens
gcccuccccugacucccuga

SEQ ID NO: 2326 - RNA, 19 nt, Homo sapiens
gggggaagaaaaggugggg

SEQ ID NO: 2327 - RNA, 19 nt, Homo sapiens
ccccaccuuuucuuccccc

SEQ ID NO: 2328 - RNA, 18 nt, Homo sapiens
cauucaacuagugauugu

SEQ ID NO: 2329 - RNA, 18 nt, Homo sapiens
acaaucacuaguugaaug

SEQ ID NO: 2330 - RNA, 18 nt, Homo sapiens
cagcagucccucccccug

SEQ ID NO: 2331 - RNA, 18 nt, Homo sapiens
cagggggagggacugcug

SEQ ID NO: 2332 - RNA, 17 nt, Homo sapiens
ccaauuaccacuucuuu

SEQ ID NO: 2333 - RNA, 17 nt, Homo sapiens
aaagaagugguaauugg

SEQ ID NO: 2334 - RNA, 17 nt, Homo sapiens
cucagugacucaugugc

SEQ ID NO: 2335 - RNA, 17 nt, Homo sapiens
gcacaugagucacugag

SEQ ID NO: 2336 - RNA, 21 nt, Homo sapiens
gcaguucugagcacaguacac

SEQ ID NO: 2337 - RNA, 21 nt, Homo sapiens
guguacugugcucagaacugc

SEQ ID NO: 2338 - RNA, 18 nt, Homo sapiens
cuaggggguuugcccuug

SEQ ID NO: 2339 - RNA, 18 nt, Homo sapiens
caagggcaaacccccuag

SEQ ID NO: 2340 - RNA, 16 nt, Homo sapiens
cucuccucccggcuuc

SEQ ID NO: 2341 - RNA, 16 nt, Homo sapiens
gaagccgggaggagag

SEQ ID NO: 2342 - RNA, 21 nt, Homo sapiens
gaguguaguucugagcagagc

SEQ ID NO: 2343 - RNA, 21 nt, Homo sapiens
gcucugcucagaacuacacuc

SEQ ID NO: 2344 - RNA, 18 nt, Homo sapiens
gggucccggggagggggg

SEQ ID NO: 2345 - RNA, 18 nt, Homo sapiens
ccccccuccccgggaccc

SEQ ID NO: 2346 - RNA, 18 nt, Homo sapiens
uaaaauuugcauccagga

SEQ ID NO: 2347 - RNA, 18 nt, Homo sapiens
uccuggaugcaaauuuua

SEQ ID NO: 2348 - RNA, 17 nt, Homo sapiens
uggggcucagcgaguuu

SEQ ID NO: 2349 - RNA, 17 nt, Homo sapiens
aaacucgcugagcccca

SEQ ID NO: 2350 - RNA, 18 nt, Homo sapiens
gggcucacaucaccccau

SEQ ID NO: 2351 - RNA, 18 nt, Homo sapiens
auggggugaugugagccc

SEQ ID NO: 2352 - RNA, 18 nt, Homo sapiens
gcggcgaguccgacucau

SEQ ID NO: 2353 - RNA, 18 nt, Homo sapiens
augagucggacucgccgc

SEQ ID NO: 2354 - RNA, 17 nt, Homo sapiens
accccacuccugguacc

SEQ ID NO: 2355 - RNA, 17 nt, Homo sapiens
gguaccaggaguggggu

SEQ ID NO: 2356 - RNA, 19 nt, Homo sapiens
ucucccuugagggcacuuu

SEQ ID NO: 2357 - RNA, 19 nt, Homo sapiens
aaagugcccucaagggaga

SEQ ID NO: 2358 - RNA, 17 nt, Homo sapiens
uugucugcugaguuucc

SEQ ID NO: 2359 - RNA, 17 nt, Homo sapiens
ggaaacucagcagacaa

SEQ ID NO: 2360 - RNA, 19 nt, Homo sapiens
gcauugugcagggcuauca

SEQ ID NO: 2361 - RNA, 19 nt, Homo sapiens
ugauagcccugcacaaugc

SEQ ID NO: 2362 - RNA, 19 nt, Homo sapiens
ugcccuccuuucuucccuc

SEQ ID NO: 2363 - RNA, 19 nt, Homo sapiens
gagggaagaaaggagggca

SEQ ID NO: 2364 - RNA, 16 nt, Homo sapiens
uucagcaggaacagcu

SEQ ID NO: 2365 - RNA, 16 nt, Homo sapiens
agcuguuccugcugaa

SEQ ID NO: 2366 - RNA, 18 nt, Homo sapiens
ccccugggccggccuugg

SEQ ID NO: 2367 - RNA, 18 nt, Homo sapiens
ccaaggccggcccagggg

SEQ ID NO: 2368 - RNA, 17 nt, Homo sapiens
cagccugacaggaacag

SEQ ID NO: 2369 - RNA, 17 nt, Homo sapiens
cuguuccugucaggcug

SEQ ID NO: 2370 - RNA, 17 nt, Homo sapiens
gggagucuacagcaggg

SEQ ID NO: 2371 - RNA, 17 nt, Homo sapiens
cccugcuguagacuccc

SEQ ID NO: 2372 - RNA, 18 nt, Homo sapiens
cagugcaauguuuuccuu

SEQ ID NO: 2373 - RNA, 18 nt, Homo sapiens
aaggaaaacauugcacug

SEQ ID NO: 2374 - RNA, 17 nt, Homo sapiens
augugggcucaggcuca

SEQ ID NO: 2375 - RNA, 17 nt, Homo sapiens
ugagccugagcccacau

SEQ ID NO: 2376 - RNA, 16 nt, Homo sapiens
ugccuuccugucugug

SEQ ID NO: 2377 - RNA, 16 nt, Homo sapiens
cacagacaggaaggca

SEQ ID NO: 2378 - RNA, 22 nt, Homo sapiens
cugggacaggaggaggaggcag

SEQ ID NO: 2379 - RNA, 22 nt, Homo sapiens
cugccuccuccuccugucccag

SEQ ID NO: 2380 - RNA, 18 nt, Homo sapiens
gcuggugacaugagaggc

SEQ ID NO: 2381 - RNA, 18 nt, Homo sapiens
gccucucaugucaccagc

SEQ ID NO: 2382 - RNA, 18 nt, Homo sapiens
ugggagcuggacuacuuc

SEQ ID NO: 2383 - RNA, 18 nt, Homo sapiens
gaaguaguccagcuccca

SEQ ID NO: 2384 - RNA, 20 nt, Homo sapiens
ucccacuacuucacuuguga

SEQ ID NO: 2385 - RNA, 20 nt, Homo sapiens
ucacaagugaaguaguggga

SEQ ID NO: 2386 - RNA, 18 nt, Homo sapiens
ccaguguggcucagcgag

SEQ ID NO: 2387 - RNA, 18 nt, Homo sapiens
cucgcugagccacacugg

SEQ ID NO: 2388 - RNA, 17 nt, Homo sapiens
uucugagcugaggacag

SEQ ID NO: 2389 - RNA, 17 nt, Homo sapiens
cuguccucagcucagaa

SEQ ID NO: 2390 - RNA, 17 nt, Homo sapiens
ccggcauguccagggca

SEQ ID NO: 2391 - RNA, 17 nt, Homo sapiens
ugcccuggacaugccgg

SEQ ID NO: 2392 - RNA, 18 nt, Homo sapiens
ccuagacaccuccaguuc

SEQ ID NO: 2393 - RNA, 18 nt, Homo sapiens
gaacuggaggugucuagg

SEQ ID NO: 2394 - RNA, 17 nt, Homo sapiens
uggagagaaaggcagua

SEQ ID NO: 2395 - RNA, 17 nt, Homo sapiens
uacugccuuucucucca

SEQ ID NO: 2396 - RNA, 19 nt, Homo sapiens
aauguuuuuuccuguuucc

SEQ ID NO: 2397 - RNA, 19 nt, Homo sapiens
ggaaacaggaaaaaacauu

SEQ ID NO: 2398 - RNA, 18 nt, Homo sapiens
ucccuggaguuucuucuu

SEQ ID NO: 2399 - RNA, 18 nt, Homo sapiens
aagaagaaacuccaggga

SEQ ID NO: 2400 - RNA, 18 nt, Homo sapiens
cuggagucuaggauucca

SEQ ID NO: 2401 - RNA, 18 nt, Homo sapiens
uggaauccuagacuccag

SEQ ID NO: 2402 - RNA, 16 nt, Homo sapiens
gcagcauucauguccc

SEQ ID NO: 2403 - RNA, 16 nt, Homo sapiens
gggacaugaaugcugc

SEQ ID NO: 2404 - RNA, 18 nt, Homo sapiens
gaaagagagcugagugug

SEQ ID NO: 2405 - RNA, 18 nt, Homo sapiens
cacacucagcucucuuuc

SEQ ID NO: 2406 - RNA, 19 nt, Homo sapiens
ggccuuguuccugucccca

SEQ ID NO: 2407 - RNA, 19 nt, Homo sapiens
uggggacaggaacaaggcc

SEQ ID NO: 2408 - RNA, 20 nt, Homo sapiens
agcccccuggccccaaaccc

SEQ ID NO: 2409 - RNA, 20 nt, Homo sapiens
ggguuuggggccagggggcu

SEQ ID NO: 2410 - RNA, 18 nt, Homo sapiens
cucugggaaaugggacag

SEQ ID NO: 2411 - RNA, 18 nt, Homo sapiens
cugucccauuucccagag

SEQ ID NO: 2412 - RNA, 18 nt, Homo sapiens
ccgcuuucugagcuggac

SEQ ID NO: 2413 - RNA, 18 nt, Homo sapiens
guccagcucagaaagcgg

SEQ ID NO: 2414 - RNA, 17 nt, Homo sapiens
ggugaggcuagcuggug

SEQ ID NO: 2415 - RNA, 17 nt, Homo sapiens
caccagcuagccucacc

SEQ ID NO: 2416 - RNA, 17 nt, Homo sapiens
acauugccagggaguuu

SEQ ID NO: 2417 - RNA, 17 nt, Homo sapiens
aaacucccuggcaaugu

SEQ ID NO: 2418 - RNA, 17 nt, Homo sapiens
cacuguggguacaugcu

SEQ ID NO: 2419 - RNA, 17 nt, Homo sapiens
agcauguacccacagug

SEQ ID NO: 2420 - RNA, 17 nt, Homo sapiens
ucccugagcaaagccac

SEQ ID NO: 2421 - RNA, 17 nt, Homo sapiens
guggcuuugcucaggga

SEQ ID NO: 2422 - RNA, 18 nt, Homo sapiens
gggauucuguagcuuccu

SEQ ID NO: 2423 - RNA, 18 nt, Homo sapiens
aggaagcuacagaauccc

SEQ ID NO: 2424 - RNA, 21 nt, Homo sapiens
uuagcgguggaccgcccugcg

SEQ ID NO: 2425 - RNA, 21 nt, Homo sapiens
cgcagggcgguccaccgcuaa

SEQ ID NO: 2426 - RNA, 21 nt, Homo sapiens
cugugggcucagcgcgugggg

SEQ ID NO: 2427 - RNA, 21 nt, Homo sapiens
ccccacgcgcugagcccacag

SEQ ID NO: 2428 - RNA, 18 nt, Homo sapiens
cagccccacagccucaga

SEQ ID NO: 2429 - RNA, 18 nt, Homo sapiens
ucugaggcuguggggcug

SEQ ID NO: 2430 - RNA, 20 nt, Homo sapiens
cccugagacccuaaccuuaa

SEQ ID NO: 2431 - RNA, 20 nt, Homo sapiens
uuaagguuagggucucaggg

SEQ ID NO: 2432 - RNA, 18 nt, Homo sapiens
uugcacuugucucaguga

SEQ ID NO: 2433 - RNA, 18 nt, Homo sapiens
ucacugagacaagugcaa

SEQ ID NO: 2434 - RNA, 20 nt, Homo sapiens
uguuccucugucucccagac

SEQ ID NO: 2435 - RNA, 20 nt, Homo sapiens
gucugggagacagaggaaca

SEQ ID NO: 2436 - RNA, 19 nt, Homo sapiens
ggcuugcaugggggacugg

SEQ ID NO: 2437 - RNA, 19 nt, Homo sapiens
ccagucccccaugcaagcc

SEQ ID NO: 2438 - RNA, 17 nt, Homo sapiens
ccaguuuucccaggauu

SEQ ID NO: 2439 - RNA, 17 nt, Homo sapiens
aauccugggaaaacugg

SEQ ID NO: 2440 - RNA, 19 nt, Homo sapiens
ccugagacccuaguuccac

SEQ ID NO: 2441 - RNA, 19 nt, Homo sapiens
guggaacuagggucucagg

SEQ ID NO: 2442 - RNA, 19 nt, Homo sapiens
ccucagaucagagccuugc

SEQ ID NO: 2443 - RNA, 19 nt, Homo sapiens
gcaaggcucugaucugagg

SEQ ID NO: 2444 - RNA, 22 nt, Homo sapiens
cauugcacuugucucggucuga

SEQ ID NO: 2445 - RNA, 22 nt, Homo sapiens
ucagaccgagacaagugcaaug

SEQ ID NO: 2446 - RNA, 21 nt, Homo sapiens
aggcggagacuugggcaauug

SEQ ID NO: 2447 - RNA, 21 nt, Homo sapiens
caauugcccaagucuccgccu

SEQ ID NO: 2448 - RNA, 22 nt, Homo sapiens
ccuauucuugguuacuugcacg

SEQ ID NO: 2449 - RNA, 22 nt, Homo sapiens
cgugcaaguaaccaagaauagg

SEQ ID NO: 2450 - RNA, 19 nt, Homo sapiens
aauggauuuuuggagcagg

SEQ ID NO: 2451 - RNA, 19 nt, Homo sapiens
ccugcuccaaaaauccauu

SEQ ID NO: 2452 - RNA, 22 nt, Homo sapiens
ugcggggcuagggcuaacagca

SEQ ID NO: 2453 - RNA, 22 nt, Homo sapiens
ugcuguuagcccuagccccgca

SEQ ID NO: 2454 - RNA, 22 nt, Homo sapiens
aaaaguaauugcggauuuugcc

SEQ ID NO: 2455 - RNA, 22 nt, Homo sapiens
ggcaaaauccgcaauuacuuuu

SEQ ID NO: 2456 - RNA, 22 nt, Homo sapiens
caaaaguaauuguggauuuugu

SEQ ID NO: 2457 - RNA, 22 nt, Homo sapiens
acaaaauccacaauuacuuuug

SEQ ID NO: 2458 - RNA, 23 nt, Homo sapiens
uaagugcuuccauguuuugguga

SEQ ID NO: 2459 - RNA, 23 nt, Homo sapiens
ucaccaaaacauggaagcacuua

SEQ ID NO: 2460 - RNA, 23 nt, Homo sapiens
acuuaaacguggauguacuugcu

SEQ ID NO: 2461 - RNA, 23 nt, Homo sapiens
agcaaguacauccacguuuaagu

SEQ ID NO: 2462 - RNA, 21 nt, Homo sapiens
cuauacaaucuacugucuuuc

SEQ ID NO: 2463 - RNA, 21 nt, Homo sapiens
gaaagacaguagauuguauag

SEQ ID NO: 2464 - RNA, 22 nt, Homo sapiens
ugagguaguagguuguauaguu

SEQ ID NO: 2465 - RNA, 22 nt, Homo sapiens
aacuauacaaccuacuaccuca

SEQ ID NO: 2466 - RNA, 22 nt, Homo sapiens
cuguacagccuccuagcuuucc

SEQ ID NO: 2467 - RNA, 22 nt, Homo sapiens
ggaaagcuaggaggcuguacag

SEQ ID NO: 2468 - RNA, 20 nt, Homo sapiens
caccaggcauuguggucucc

SEQ ID NO: 2469 - RNA, 20 nt, Homo sapiens
ggagaccacaaugccuggug

SEQ ID NO: 2470 - RNA, 23 nt, Homo sapiens
ugaguaccgccaugucuguuggg

SEQ ID NO: 2471 - RNA, 23 nt, Homo sapiens
cccaacagacauggcgguacuca

SEQ ID NO: 2472 - RNA, 22 nt, Homo sapiens
uacccagagcaugcagugugaa

SEQ ID NO: 2473 - RNA, 22 nt, Homo sapiens
uucacacugcaugcucugggua

SEQ ID NO: 2474 - RNA, 22 nt, Homo sapiens
aagugcugucauagcugagguc

SEQ ID NO: 2475 - RNA, 22 nt, Homo sapiens
gaccucagcuaugacagcacuu

SEQ ID NO: 2476 - RNA, 23 nt, Homo sapiens
cacucagccuugagggcacuuuc

SEQ ID NO: 2477 - RNA, 23 nt, Homo sapiens
gaaagugcccucaaggcugagug

SEQ ID NO: 2478 - RNA, 22 nt, Homo sapiens
ucgacagcacgacacugccuuc

SEQ ID NO: 2479 - RNA, 22 nt, Homo sapiens
gaaggcagugucgugcugucga

SEQ ID NO: 2480 - RNA, 22 nt, Homo sapiens
uagguaguuuccuguuguuggg

SEQ ID NO: 2481 - RNA, 22 nt, Homo sapiens
cccaacaacaggaaacuaccua

SEQ ID NO: 2482 - RNA, 21 nt, Homo sapiens
uacaguacugugauaacugaa

SEQ ID NO: 2483 - RNA, 21 nt, Homo sapiens
uucaguuaucacaguacugua

SEQ ID NO: 2484 - RNA, 22 nt, Homo sapiens
caguuaucacagugcugaugcu

SEQ ID NO: 2485 - RNA, 22 nt, Homo sapiens
agcaucagcacugugauaacug

SEQ ID NO: 2486 - RNA, 23 nt, Homo sapiens
ugugcaaaucuaugcaaaacuga

SEQ ID NO: 2487 - RNA, 23 nt, Homo sapiens
ucaguuuugcauagauuugcaca

SEQ ID NO: 2488 - RNA, 22 nt, Homo sapiens
aguuuugcauaguugcacuaca

SEQ ID NO: 2489 - RNA, 22 nt, Homo sapiens
uguagugcaacuaugcaaaacu

SEQ ID NO: 2490 - RNA, 23 nt, Homo sapiens
aguuuugcagguuugcauccagc

SEQ ID NO: 2491 - RNA, 23 nt, Homo sapiens
gcuggaugcaaaccugcaaaacu

SEQ ID NO: 2492 - RNA, 22 nt, Homo sapiens
aguuuugcagguuugcauuuca

SEQ ID NO: 2493 - RNA, 22 nt, Homo sapiens
ugaaaugcaaaccugcaaaacu

SEQ ID NO: 2494 - RNA, 23 nt, Homo sapiens
ugugcaaauccaugcaaaacuga

SEQ ID NO: 2495 - RNA, 23 nt, Homo sapiens
ucaguuuugcauggauuugcaca

SEQ ID NO: 2496 - RNA, 23 nt, Homo sapiens
uacugcaucaggaacugauugga

SEQ ID NO: 2497 - RNA, 23 nt, Homo sapiens
uccaaucaguuccugaugcagua

SEQ ID NO: 2498 - RNA, 22 nt, Homo sapiens
augguuccgucaagcaccaugg

SEQ ID NO: 2499 - RNA, 22 nt, Homo sapiens
ccauggugcuugacggaaccau

SEQ ID NO: 2500 - RNA, 21 nt, Homo sapiens
agcuacaucuggcuacugggu

SEQ ID NO: 2501 - RNA, 21 nt, Homo sapiens
acccaguagccagauguagcu

SEQ ID NO: 2502 - RNA, 22 nt, Homo sapiens
cucaguagccaguguagauccu

SEQ ID NO: 2503 - RNA, 22 nt, Homo sapiens
aggaucuacacuggcuacugag

SEQ ID NO: 2504 - RNA, 22 nt, Homo sapiens
uuaucagaaucuccagggguac

SEQ ID NO: 2505 - RNA, 22 nt, Homo sapiens
guaccccuggagauucugauaa

SEQ ID NO: 2506 - RNA, 23 nt, Homo sapiens
aucaacagacauuaauugggcgc

SEQ ID NO: 2507 - RNA, 23 nt, Homo sapiens
gcgcccaauuaaugucuguugau

SEQ ID NO: 2508 - RNA, 21 nt, Homo sapiens
caaaacgugaggcgcugcuau

SEQ ID NO: 2509 - RNA, 21 nt, Homo sapiens
auagcagcgccucacguuuug

SEQ ID NO: 2510 - RNA, 22 nt, Homo sapiens
cagcagcaauucauguuuugaa

SEQ ID NO: 2511 - RNA, 22 nt, Homo sapiens
uucaaaacaugaauugcugcug

SEQ ID NO: 2512 - RNA, 18 nt, Homo sapiens
uucacagggaggugucau

SEQ ID NO: 2513 - RNA, 18 nt, Homo sapiens
augacaccucccugugaa

SEQ ID NO: 2514 - RNA, 20 nt, Homo sapiens
gcggagagagaauggggagc

SEQ ID NO: 2515 - RNA, 20 nt, Homo sapiens
gcuccccauucucucuccgc

SEQ ID NO: 2516 - RNA, 21 nt, Homo sapiens
ccugcgagucuccggcggugg

SEQ ID NO: 2517 - RNA, 21 nt, Homo sapiens
ccaccgccggagacucgcagg

SEQ ID NO: 2518 - RNA, 21 nt, Homo sapiens
gggcuagggccugcugccccc

SEQ ID NO: 2519 - RNA, 21 nt, Homo sapiens
gggggcagcaggcccuagccc

SEQ ID NO: 2520 - RNA, 19 nt, Homo sapiens
uucugcugccggccaaggc

SEQ ID NO: 2521 - RNA, 19 nt, Homo sapiens
gccuuggccggcagcagaa

SEQ ID NO: 2522 - RNA, 22 nt, Homo sapiens
uccucaucacacugcaccuuag

SEQ ID NO: 2523 - RNA, 22 nt, Homo sapiens
cuaaggugcagugugaugagga

SEQ ID NO: 2524 - RNA, 20 nt, Homo sapiens
gguagugaguuaucagcuac

SEQ ID NO: 2525 - RNA, 20 nt, Homo sapiens
guagcugauaacucacuacc

SEQ ID NO: 2526 - RNA, 20 nt, Homo sapiens
gauauucagaggcuaggugg

SEQ ID NO: 2527 - RNA, 20 nt, Homo sapiens
ccaccuagccucugaauauc

SEQ ID NO: 2528 - RNA, 21 nt, Homo sapiens
acggcccaggcggcauuggug

SEQ ID NO: 2529 - RNA, 21 nt, Homo sapiens
caccaaugccgccugggccgu

SEQ ID NO: 2530 - RNA, 21 nt, Homo sapiens
agcaugacagaggagaggugg

SEQ ID NO: 2531 - RNA, 21 nt, Homo sapiens
ccaccucuccucugucaugcu

SEQ ID NO: 2532 - RNA, 21 nt, Homo sapiens
gggaagagcuguacggccuuc

SEQ ID NO: 2533 - RNA, 21 nt, Homo sapiens
gaaggccguacagcucuuccc

SEQ ID NO: 2534 - RNA, 19 nt, Homo sapiens
ccgccugagcuagcugugg

SEQ ID NO: 2535 - RNA, 19 nt, Homo sapiens
ccacagcuagcucaggcgg

SEQ ID NO: 2536 - RNA, 24 nt, Homo sapiens
uuggaagcuuggaccaacuagcug

SEQ ID NO: 2537 - RNA, 24 nt, Homo sapiens
cagcuaguugguccaagcuuccaa

SEQ ID NO: 2538 - RNA, 19 nt, Homo sapiens
ucuagugcgggcguucccg

SEQ ID NO: 2539 - RNA, 19 nt, Homo sapiens
cgggaacgcccgcacuaga

SEQ ID NO: 2540 - RNA, 24 nt, Homo sapiens
aggagcagugccggccaaggcgcc

SEQ ID NO: 2541 - RNA, 24 nt, Homo sapiens
ggcgccuuggccggcacugcuccu

SEQ ID NO: 2542 - RNA, 19 nt, Homo sapiens
gaauacgucugguugaucc

SEQ ID NO: 2543 - RNA, 19 nt, Homo sapiens
ggaucaaccagacguauuc

SEQ ID NO: 2544 - RNA, 20 nt, Homo sapiens
cuuauaucagaggcuguggg

SEQ ID NO: 2545 - RNA, 20 nt, Homo sapiens
cccacagccucugauauaag

SEQ ID NO: 2546 - RNA, 20 nt, Homo sapiens
uuccgccagucgguggccgg

SEQ ID NO: 2547 - RNA, 20 nt, Homo sapiens
ccggccaccgacuggcggaa

SEQ ID NO: 2548 - RNA, 19 nt, Homo sapiens
aaggggcugggggagcaca

SEQ ID NO: 2549 - RNA, 19 nt, Homo sapiens
ugugcucccccagccccuu

SEQ ID NO: 2550 - RNA, 23 nt, Homo sapiens
agguugggaucgguugcaaugcu

SEQ ID NO: 2551 - RNA, 23 nt, Homo sapiens
agcauugcaaccgaucccaaccu

SEQ ID NO: 2552 - RNA, 22 nt, Homo sapiens
ggguggggauuuguugcauuac

SEQ ID NO: 2553 - RNA, 22 nt, Homo sapiens
guaaugcaacaaauccccaccc

SEQ ID NO: 2554 - RNA, 22 nt, Homo sapiens
uauugcacuugucccggccugu

SEQ ID NO: 2555 - RNA, 22 nt, Homo sapiens
acaggccgggacaagugcaaua

SEQ ID NO: 2556 - RNA, 22 nt, Homo sapiens
uauugcacucgucccggccucc

SEQ ID NO: 2557 - RNA, 22 nt, Homo sapiens
ggaggccgggacgagugcaaua

SEQ ID NO: 2558 - RNA, 22 nt, Homo sapiens
agggacgggacgcggugcagug

SEQ ID NO: 2559 - RNA, 22 nt, Homo sapiens
cacugcaccgcgucccgucccu

SEQ ID NO: 2560 - RNA, 21 nt, Homo sapiens
aucacauugccagggauuucc

SEQ ID NO: 2561 - RNA, 21 nt, Homo sapiens
ggaaaucccuggcaaugugau

SEQ ID NO: 2562 - RNA, 22 nt, Homo sapiens
gggguuccuggggaugggauuu

SEQ ID NO: 2563 - RNA, 22 nt, Homo sapiens
aaaucccauccccaggaacccc

SEQ ID NO: 2564 - RNA, 22 nt, Homo sapiens
acugcagugaaggcacuuguag

SEQ ID NO: 2565 - RNA, 22 nt, Homo sapiens
cuacaagugccuucacugcagu

SEQ ID NO: 2566 - RNA, 23 nt, Homo sapiens
agcuacauugucugcuggguuuc

SEQ ID NO: 2567 - RNA, 23 nt, Homo sapiens
gaaacccagcagacaauguagcu

SEQ ID NO: 2568 - RNA, 22 nt, Homo sapiens
accuggcauacaauguagauuu

SEQ ID NO: 2569 - RNA, 22 nt, Homo sapiens
aaaucuacauuguaugccaggu

SEQ ID NO: 2570 - RNA, 22 nt, Homo sapiens
ucguaccgugaguaauaaugcg

SEQ ID NO: 2571 - RNA, 22 nt, Homo sapiens
cgcauuauuacucacgguacga

SEQ ID NO: 2572 - RNA, 21 nt, Homo sapiens
cauuauuacuuuugguacgcg

SEQ ID NO: 2573 - RNA, 21 nt, Homo sapiens
cgcguaccaaaaguaauaaug

SEQ ID NO: 2574 - RNA, 23 nt, Homo sapiens
uacuccagagggcgucacucaug

SEQ ID NO: 2575 - RNA, 23 nt, Homo sapiens
caugagugacgcccucuggagua

SEQ ID NO: 2576 - RNA, 21 nt, Homo sapiens
ucccacguuguggcccagcag

SEQ ID NO: 2577 - RNA, 21 nt, Homo sapiens
cugcugggccacaacguggga

SEQ ID NO: 2578 - RNA, 23 nt, Homo sapiens
ccucaccaccccuucugccugca

SEQ ID NO: 2579 - RNA, 23 nt, Homo sapiens
ugcaggcagaagggguggugagg

SEQ ID NO: 2580 - RNA, 24 nt, Homo sapiens
cugcaggcagaaguggggcugaca

SEQ ID NO: 2581 - RNA, 24 nt, Homo sapiens
ugucagccccacuucugccugcag

SEQ ID NO: 2582 - RNA, 21 nt, Homo sapiens
ccaaaccagucgugccugugg

SEQ ID NO: 2583 - RNA, 21 nt, Homo sapiens
ccacaggcacgacugguuugg

SEQ ID NO: 2584 - RNA, 22 nt, Homo sapiens
cucaaaccggcugugccugugg

SEQ ID NO: 2585 - RNA, 22 nt, Homo sapiens
ccacaggcacagccgguuugag

SEQ ID NO: 2586 - RNA, 21 nt, Homo sapiens
acaggcacgacugguuuggca

SEQ ID NO: 2587 - RNA, 21 nt, Homo sapiens
ugccaaaccagucgugccugu

SEQ ID NO: 2588 - RNA, 22 nt, Homo sapiens
uccgaacucuccauuccucugc

SEQ ID NO: 2589 - RNA, 22 nt, Homo sapiens
gcagaggaauggagaguucgga

SEQ ID NO: 2590 - RNA, 20 nt, Homo sapiens
ugggaauggggguaagggcc

SEQ ID NO: 2591 - RNA, 20 nt, Homo sapiens
ggcccuuacccccauuccca

SEQ ID NO: 2592 - RNA, 22 nt, Homo sapiens
aggcgauguggggauguagaga

SEQ ID NO: 2593 - RNA, 22 nt, Homo sapiens
ucucuacauccccacaucgccu

SEQ ID NO: 2594 - RNA, 21 nt, Homo sapiens
uaguggucagagggcuuauga

SEQ ID NO: 2595 - RNA, 21 nt, Homo sapiens
ucauaagcccucugaccacua

SEQ ID NO: 2596 - RNA, 22 nt, Homo sapiens
ucugacaucagugauucuccug

SEQ ID NO: 2597 - RNA, 22 nt, Homo sapiens
caggagaaucacugaugucaga

SEQ ID NO: 2598 - RNA, 22 nt, Homo sapiens
cgcgccugcaggaacugguaga

SEQ ID NO: 2599 - RNA, 22 nt, Homo sapiens
ucuaccaguuccugcaggcgcg

SEQ ID NO: 2600 - RNA, 23 nt, Homo sapiens
ugggcaggggcuuauuguaggag

SEQ ID NO: 2601 - RNA, 23 nt, Homo sapiens
cuccuacaauaagccccugccca

SEQ ID NO: 2602 - RNA, 22 nt, Homo sapiens
ugcaggggucgggugggccagg

SEQ ID NO: 2603 - RNA, 22 nt, Homo sapiens
ccuggcccacccgaccccugca

SEQ ID NO: 2604 - RNA, 20 nt, Homo sapiens
aggcgcacccgaccacaugc

SEQ ID NO: 2605 - RNA, 20 nt, Homo sapiens
gcauguggucgggugcgccu

SEQ ID NO: 2606 - RNA, 22 nt, Homo sapiens
auaguccgaguaacgucggggc

SEQ ID NO: 2607 - RNA, 22 nt, Homo sapiens
gccccgacguuacucggacuau

SEQ ID NO: 2608 - RNA, 23 nt, Homo sapiens
cugggcccgcggcgggcgugggg

SEQ ID NO: 2609 - RNA, 23 nt, Homo sapiens
ccccacgcccgccgcgggcccag

SEQ ID NO: 2610 - RNA, 21 nt, Homo sapiens
uacuuggaaaggcaucaguug

SEQ ID NO: 2611 - RNA, 21 nt, Homo sapiens
caacugaugccuuuccaagua

SEQ ID NO: 2612 - RNA, 22 nt, Homo sapiens
ugcaacgaaccugagccacuga

SEQ ID NO: 2613 - RNA, 22 nt, Homo sapiens
ucaguggcucagguucguugca

SEQ ID NO: 2614 - RNA, 22 nt, Homo sapiens
ugcaacuuaccugagucauuga

SEQ ID NO: 2615 - RNA, 22 nt, Homo sapiens
ucaaugacucagguaaguugca

SEQ ID NO: 2616 - RNA, 21 nt, Homo sapiens
cacuguguccuuucugcguag

SEQ ID NO: 2617 - RNA, 21 nt, Homo sapiens
cuacgcagaaaggacacagug

SEQ ID NO: 2618 - RNA, 22 nt, Homo sapiens
cacuggcuccuuucuggguaga

SEQ ID NO: 2619 - RNA, 22 nt, Homo sapiens
ucuacccagaaaggagccagug

SEQ ID NO: 2620 - RNA, 22 nt, Homo sapiens
cacuguuuccuuucugagugga

SEQ ID NO: 2621 - RNA, 22 nt, Homo sapiens
uccacucagaaaggaaacagug

SEQ ID NO: 2622 - RNA, 21 nt, Homo sapiens
uauucagaaaggugccaguca

SEQ ID NO: 2623 - RNA, 21 nt, Homo sapiens
ugacuggcaccuuucugaaua

SEQ ID NO: 2624 - RNA, 20 nt, Homo sapiens
auuccuagaaauuguucaua

SEQ ID NO: 2625 - RNA, 20 nt, Homo sapiens
uaugaacaauuucuaggaau

SEQ ID NO: 2626 - RNA, 22 nt, Homo sapiens
uaauacugucugguaaaaccgu

SEQ ID NO: 2627 - RNA, 22 nt, Homo sapiens
acgguuuuaccagacaguauua

SEQ ID NO: 2628 - RNA, 22 nt, Homo sapiens
ugaaacauacacgggaaaccuc

SEQ ID NO: 2629 - RNA, 22 nt, Homo sapiens
gagguuucccguguauguuuca

SEQ ID NO: 2630 - RNA, 22 nt, Homo sapiens
cuauacaaccuacugccuuccc

SEQ ID NO: 2631 - RNA, 22 nt, Homo sapiens
gggaaggcaguagguuguauag

SEQ ID NO: 2632 - RNA, 22 nt, Homo sapiens
ugagguaguagguugugugguu

SEQ ID NO: 2633 - RNA, 22 nt, Homo sapiens
aaccacacaaccuacuaccuca

SEQ ID NO: 2634 - RNA, 22 nt, Homo sapiens
uaacacugucugguaacgaugu

SEQ ID NO: 2635 - RNA, 22 nt, Homo sapiens
acaucguuaccagacaguguua

SEQ ID NO: 2636 - RNA, 22 nt, Homo sapiens
caucuuaccggacagugcugga

SEQ ID NO: 2637 - RNA, 22 nt, Homo sapiens
uccagcacuguccgguaagaug

SEQ ID NO: 2638 - RNA, 22 nt, Homo sapiens
uaauacugccugguaaugauga

SEQ ID NO: 2639 - RNA, 22 nt, Homo sapiens
ucaucauuaccaggcaguauua

SEQ ID NO: 2640 - RNA, 22 nt, Homo sapiens
caucuuacugggcagcauugga

SEQ ID NO: 2641 - RNA, 22 nt, Homo sapiens
uccaaugcugcccaguaagaug

SEQ ID NO: 2642 - RNA, 23 nt, Homo sapiens
uaauacugccggguaaugaugga

SEQ ID NO: 2643 - RNA, 23 nt, Homo sapiens
uccaucauuacccggcaguauua

SEQ ID NO: 2644 - RNA, 22 nt, Homo sapiens
cgucuuacccagcaguguuugg

SEQ ID NO: 2645 - RNA, 22 nt, Homo sapiens
ccaaacacugcuggguaagacg

SEQ ID NO: 2646 - RNA, 22 nt, Homo sapiens
uccagcaucagugauuuuguug

SEQ ID NO: 2647 - RNA, 22 nt, Homo sapiens
caacaaaaucacugaugcugga

SEQ ID NO: 2648 - RNA, 20 nt, Homo sapiens
uacaguauagaugauguacu

SEQ ID NO: 2649 - RNA, 20 nt, Homo sapiens
aguacaucaucuauacugua

SEQ ID NO: 2650 - RNA, 22 nt, Homo sapiens
ggauaucaucauauacuguaag

SEQ ID NO: 2651 - RNA, 22 nt, Homo sapiens
cuuacaguauaugaugauaucc

SEQ ID NO: 2652 - RNA, 21 nt, Homo sapiens
cggggcagcucaguacaggau

SEQ ID NO: 2653 - RNA, 21 nt, Homo sapiens
auccuguacugagcugccccg

SEQ ID NO: 2654 - RNA, 21 nt, Homo sapiens
uccuucugcuccgucccccag

SEQ ID NO: 2655 - RNA, 21 nt, Homo sapiens
cugggggacggagcagaagga

SEQ ID NO: 2656 - RNA, 21 nt, Homo sapiens
cgggggcggggccgaagcgcg

SEQ ID NO: 2657 - RNA, 21 nt, Homo sapiens
cgcgcuucggccccgcccccg

SEQ ID NO: 2658 - RNA, 21 nt, Homo sapiens
uccugcgcgucccagaugccc

SEQ ID NO: 2659 - RNA, 21 nt, Homo sapiens
gggcaucugggacgcgcagga

SEQ ID NO: 2660 - RNA, 22 nt, Homo sapiens
caucagaauucauggaggcuag

SEQ ID NO: 2661 - RNA, 22 nt, Homo sapiens
cuagccuccaugaauucugaug

SEQ ID NO: 2662 - RNA, 22 nt, Homo sapiens
agcuuccaugacuccugaugga

SEQ ID NO: 2663 - RNA, 22 nt, Homo sapiens
uccaucaggagucauggaagcu

SEQ ID NO: 2664 - RNA, 21 nt, Homo sapiens
ugacagcgcccugccuggcuc

SEQ ID NO: 2665 - RNA, 21 nt, Homo sapiens
gagccaggcagggcgcuguca

SEQ ID NO: 2666 - RNA, 24 nt, Homo sapiens
agcgcgggcugagcgcugccaguc

SEQ ID NO: 2667 - RNA, 24 nt, Homo sapiens
gacuggcagcgcucagcccgcgcu

SEQ ID NO: 2668 - RNA, 22 nt, Homo sapiens
cugggaggugugauaucguggu

SEQ ID NO: 2669 - RNA, 22 nt, Homo sapiens
accacgauaucacaccucccag

SEQ ID NO: 2670 - RNA, 22 nt, Homo sapiens
ugugauaucaugguuccuggga

SEQ ID NO: 2671 - RNA, 22 nt, Homo sapiens
ucccaggaaccaugauaucaca

SEQ ID NO: 2672 - RNA, 22 nt, Homo sapiens
aggugcuccaggcuggcucaca

SEQ ID NO: 2673 - RNA, 22 nt, Homo sapiens
ugugagccagccuggagcaccu

SEQ ID NO: 2674 - RNA, 22 nt, Homo sapiens
gagcaauguagguagacuguuu

SEQ ID NO: 2675 - RNA, 22 nt, Homo sapiens
aaacagucuaccuacauugcuc

SEQ ID NO: 2676 - RNA, 22 nt, Homo sapiens
uguccucuagggccugcagucu

SEQ ID NO: 2677 - RNA, 22 nt, Homo sapiens
agacugcaggcccuagaggaca

SEQ ID NO: 2678 - RNA, 20 nt, Homo sapiens
aaaggcauaaaaccaagaca

SEQ ID NO: 2679 - RNA, 20 nt, Homo sapiens
ugucuugguuuuaugccuuu

SEQ ID NO: 2680 - RNA, 21 nt, Homo sapiens
uaacgcauaauauggacaugu

SEQ ID NO: 2681 - RNA, 21 nt, Homo sapiens
acauguccauauuaugcguua

SEQ ID NO: 2682 - RNA, 22 nt, Homo sapiens
uugaggaaaagauggucuuauu

SEQ ID NO: 2683 - RNA, 22 nt, Homo sapiens
aauaagaccaucuuuuccucaa

SEQ ID NO: 2684 - RNA, 26 nt, Homo sapiens
aagaggaagaaauggcugguucucag

SEQ ID NO: 2685 - RNA, 26 nt, Homo sapiens
cugagaaccagccauuucuuccucuu

SEQ ID NO: 2686 - RNA, 20 nt, Homo sapiens
gcucggacugagcagguggg

SEQ ID NO: 2687 - RNA, 20 nt, Homo sapiens
cccaccugcucaguccgagc

SEQ ID NO: 2688 - RNA, 21 nt, Homo sapiens
acagggccgcagauggagacu

SEQ ID NO: 2689 - RNA, 21 nt, Homo sapiens
agucuccaucugcggcccugu

SEQ ID NO: 2690 - RNA, 21 nt, Homo sapiens
gcagagaacaaaggacucagu

SEQ ID NO: 2691 - RNA, 21 nt, Homo sapiens
acugaguccuuuguucucugc

SEQ ID NO: 2692 - RNA, 22 nt, Homo sapiens
acugauuaucuuaacucucuga

SEQ ID NO: 2693 - RNA, 22 nt, Homo sapiens
ucagagaguuaagauaaucagu

SEQ ID NO: 2694 - RNA, 23 nt, Homo sapiens
ucucugaguaccauaugccuugu

SEQ ID NO: 2695 - RNA, 23 nt, Homo sapiens
acaaggcauaugguacucagaga

SEQ ID NO: 2696 - RNA, 22 nt, Homo sapiens
aacuaguaauguuggauuaggg

SEQ ID NO: 2697 - RNA, 22 nt, Homo sapiens
cccuaauccaacauuacuaguu

SEQ ID NO: 2698 - RNA, 22 nt, Homo sapiens
auauguauaugugacugcuacu

SEQ ID NO: 2699 - RNA, 22 nt, Homo sapiens
aguagcagucacauauacauau

SEQ ID NO: 2700 - RNA, 21 nt, Homo sapiens
uggccaaaaagcaggcagaga

SEQ ID NO: 2701 - RNA, 21 nt, Homo sapiens
ucucugccugcuuuuuggcca

SEQ ID NO: 2702 - RNA, 22 nt, Homo sapiens
ggaggaaccuuggagcuucggc

SEQ ID NO: 2703 - RNA, 22 nt, Homo sapiens
gccgaagcuccaagguuccucc

SEQ ID NO: 2704 - RNA, 23 nt, Homo sapiens
gaggcugaugugaguagaccacu

SEQ ID NO: 2705 - RNA, 23 nt, Homo sapiens
aguggucuacucacaucagccuc

SEQ ID NO: 2706 - RNA, 21 nt, Homo sapiens
cuguccuaagguuguugaguu

SEQ ID NO: 2707 - RNA, 21 nt, Homo sapiens
aacucaacaaccuuaggacag

SEQ ID NO: 2708 - RNA, 21 nt, Homo sapiens
ucuucaaccucaggacuugca

SEQ ID NO: 2709 - RNA, 21 nt, Homo sapiens
ugcaaguccugagguugaaga

SEQ ID NO: 2710 - RNA, 22 nt, Homo sapiens
ugugauaucaugguuccuggga

SEQ ID NO: 2711 - RNA, 22 nt, Homo sapiens
ucccaggaaccaugauaucaca

SEQ ID NO: 2712 - RNA, 22 nt, Homo sapiens
cugggaggugugauauuguggu

SEQ ID NO: 2713 - RNA, 22 nt, Homo sapiens
accacaauaucacaccucccag

SEQ ID NO: 2714 - RNA, 22 nt, Homo sapiens
cagguagauauuugauaggcau

SEQ ID NO: 2715 - RNA, 22 nt, Homo sapiens
augccuaucaaauaucuaccug

SEQ ID NO: 2716 - RNA, 21 nt, Homo sapiens
gccuaucacauaucugccugu

SEQ ID NO: 2717 - RNA, 21 nt, Homo sapiens
acaggcagauaugugauaggc

SEQ ID NO: 2718 - RNA, 20 nt, Homo sapiens
gggcuggggcgcggggaggu

SEQ ID NO: 2719 - RNA, 20 nt, Homo sapiens
accuccccgcgccccagccc

SEQ ID NO: 2720 - RNA, 18 nt, Homo sapiens
ugcuuccuuucagagggu

SEQ ID NO: 2721 - RNA, 18 nt, Homo sapiens
acccucugaaaggaagca

SEQ ID NO: 2722 - RNA, 21 nt, Homo sapiens
ugaguuggccaucugagugag

SEQ ID NO: 2723 - RNA, 21 nt, Homo sapiens
cucacucagauggccaacuca

SEQ ID NO: 2724 - RNA, 23 nt, Homo sapiens
aacauucauuguugucggugggu

SEQ ID NO: 2725 - RNA, 23 nt, Homo sapiens
acccaccgacaacaaugaauguu

SEQ ID NO: 2726 - RNA, 21 nt, Homo sapiens
ucacagugaaccggucucuuu

SEQ ID NO: 2727 - RNA, 21 nt, Homo sapiens
aaagagaccgguucacuguga

SEQ ID NO: 2728 - RNA, 22 nt, Homo sapiens
caacaaaucacagucugccaua

SEQ ID NO: 2729 - RNA, 22 nt, Homo sapiens
uauggcagacugugauuuguug

SEQ ID NO: 2730 - RNA, 21 nt, Homo sapiens
cucacugaacaaugaaugcaa

SEQ ID NO: 2731 - RNA, 21 nt, Homo sapiens
uugcauucauuguucagugag

SEQ ID NO: 2732 - RNA, 23 nt, Homo sapiens
aacauucauugcugucggugggu

SEQ ID NO: 2733 - RNA, 23 nt, Homo sapiens
acccaccgacagcaaugaauguu

SEQ ID NO: 2734 - RNA, 22 nt, Homo sapiens
accaucgaccguugauuguacc

SEQ ID NO: 2735 - RNA, 22 nt, Homo sapiens
gguacaaucaacggucgauggu

SEQ ID NO: 2736 - RNA, 23 nt, Homo sapiens
aacauucaacgcugucggugagu

SEQ ID NO: 2737 - RNA, 23 nt, Homo sapiens
acucaccgacagcguugaauguu

SEQ ID NO: 2738 - RNA, 22 nt, Homo sapiens
accacugaccguugacuguacc

SEQ ID NO: 2739 - RNA, 22 nt, Homo sapiens
gguacagucaacggucaguggu

SEQ ID NO: 2740 - RNA, 22 nt, Homo sapiens
cuguugccacuaaccucaaccu

SEQ ID NO: 2741 - RNA, 22 nt, Homo sapiens
agguugagguuaguggcaacag

SEQ ID NO: 2742 - RNA, 22 nt, Homo sapiens
auaagacgagcaaaaagcuugu

SEQ ID NO: 2743 - RNA, 22 nt, Homo sapiens
acaagcuuuuugcucgucuuau

SEQ ID NO: 2744 - RNA, 22 nt, Homo sapiens
auaagacgaacaaaagguuugu

SEQ ID NO: 2745 - RNA, 22 nt, Homo sapiens
acaaaccuuuuguucgucuuau

SEQ ID NO: 2746 - RNA, 21 nt, Homo sapiens
agggagggacgggggcugugc

SEQ ID NO: 2747 - RNA, 21 nt, Homo sapiens
gcacagcccccgucccucccu

SEQ ID NO: 2748 - RNA, 23 nt, Homo sapiens
ucuggcuccgugucuucacuccc

SEQ ID NO: 2749 - RNA, 23 nt, Homo sapiens
gggagugaagacacggagccaga

SEQ ID NO: 2750 - RNA, 22 nt, Homo sapiens
uggaauguaaagaaguauguau

SEQ ID NO: 2751 - RNA, 22 nt, Homo sapiens
auacauacuucuuuacauucca

SEQ ID NO: 2752 - RNA, 22 nt, Homo sapiens
aacaucacagcaagucugugcu

SEQ ID NO: 2753 - RNA, 22 nt, Homo sapiens
agcacagacuugcugugauguu

SEQ ID NO: 2754 - RNA, 21 nt, Homo sapiens
uuaagacuugcagugauguuu

SEQ ID NO: 2755 - RNA, 21 nt, Homo sapiens
aaacaucacugcaagucuuaa

SEQ ID NO: 2756 - RNA, 22 nt, Homo sapiens
aacaucacugcaagucuuaaca

SEQ ID NO: 2757 - RNA, 22 nt, Homo sapiens
uguuaagacuugcagugauguu

SEQ ID NO: 2758 - RNA, 21 nt, Homo sapiens
acagacuugcugugauguuca

SEQ ID NO: 2759 - RNA, 21 nt, Homo sapiens
ugaacaucacagcaagucugu

SEQ ID NO: 2760 - RNA, 22 nt, Homo sapiens
aaaccguuaccauuacugaguu

SEQ ID NO: 2761 - RNA, 22 nt, Homo sapiens
aacucaguaaugguaacgguuu

SEQ ID NO: 2762 - RNA, 22 nt, Homo sapiens
uagcaagagaaccauuaccauu

SEQ ID NO: 2763 - RNA, 22 nt, Homo sapiens
aaugguaaugguucucuugcua

SEQ ID NO: 2764 - RNA, 23 nt, Homo sapiens
ugaggggcagagagcgagacuuu

SEQ ID NO: 2765 - RNA, 23 nt, Homo sapiens
aaagucucgcucucugccccuca

SEQ ID NO: 2766 - RNA, 22 nt, Homo sapiens
caagcucgcuucuaugggucug

SEQ ID NO: 2767 - RNA, 22 nt, Homo sapiens
cagacccauagaagcgagcuug

SEQ ID NO: 2768 - RNA, 22 nt, Homo sapiens
aacccguagauccgaucuugug

SEQ ID NO: 2769 - RNA, 22 nt, Homo sapiens
cacaagaucggaucuacggguu

SEQ ID NO: 2770 - RNA, 22 nt, Homo sapiens
caagcucgugucuguggguccg

SEQ ID NO: 2771 - RNA, 22 nt, Homo sapiens
cggacccacagacacgagcuug

SEQ ID NO: 2772 - RNA, 22 nt, Homo sapiens
cacccguagaaccgaccuugcg

SEQ ID NO: 2773 - RNA, 22 nt, Homo sapiens
cgcaaggucgguucuacgggug

SEQ ID NO: 2774 - RNA, 23 nt, Homo sapiens
uggagacgcggcccuguuggagu

SEQ ID NO: 2775 - RNA, 23 nt, Homo sapiens
acuccaacagggccgcgucucca

SEQ ID NO: 2776 - RNA, 23 nt, Homo sapiens
ucuacagugcacgugucuccagu

SEQ ID NO: 2777 - RNA, 23 nt, Homo sapiens
acuggagacacgugcacuguaga

SEQ ID NO: 2778 - RNA, 22 nt, Homo sapiens
caaauucguaucuaggggaaua

SEQ ID NO: 2779 - RNA, 22 nt, Homo sapiens
uauuccccuagauacgaauuug

SEQ ID NO: 2780 - RNA, 23 nt, Homo sapiens
uacccuguagauccgaauuugug

SEQ ID NO: 2781 - RNA, 23 nt, Homo sapiens
cacaaauucggaucuacagggua

SEQ ID NO: 2782 - RNA, 23 nt, Homo sapiens
ccugcagcgacuugauggcuucc

SEQ ID NO: 2783 - RNA, 23 nt, Homo sapiens
ggaagccaucaagucgcugcagg

SEQ ID NO: 2784 - RNA, 22 nt, Homo sapiens
ucagugcacuacagaacuuugu

SEQ ID NO: 2785 - RNA, 22 nt, Homo sapiens
acaaaguucuguagugcacuga

SEQ ID NO: 2786 - RNA, 22 nt, Homo sapiens
aaaguucugagacacuccgacu

SEQ ID NO: 2787 - RNA, 22 nt, Homo sapiens
agucggagugucucagaacuuu

SEQ ID NO: 2788 - RNA, 22 nt, Homo sapiens
ccuguucuccauuacuuggcuc

SEQ ID NO: 2789 - RNA, 22 nt, Homo sapiens
gagccaaguaauggagaacagg

SEQ ID NO: 2790 - RNA, 21 nt, Homo sapiens
uucaaguaauucaggauaggu

SEQ ID NO: 2791 - RNA, 21 nt, Homo sapiens
accuauccugaauuacuugaa

SEQ ID NO: 2792 - RNA, 22 nt, Homo sapiens
gcccugaacgaggggucuggag

SEQ ID NO: 2793 - RNA, 22 nt, Homo sapiens
cuccagaccccucguucagggc

SEQ ID NO: 2794 - RNA, 22 nt, Homo sapiens
gcugacuccuaguccagggcuc

SEQ ID NO: 2795 - RNA, 22 nt, Homo sapiens
gagcccuggacuaggagucagc

SEQ ID NO: 2796 - RNA, 22 nt, Homo sapiens
aucacacaaaggcaacuuuugu

SEQ ID NO: 2797 - RNA, 22 nt, Homo sapiens
acaaaaguugccuuugugugau

SEQ ID NO: 2798 - RNA, 22 nt, Homo sapiens
agagguugcccuuggugaauuc

SEQ ID NO: 2799 - RNA, 22 nt, Homo sapiens
gaauucaccaagggcaaccucu

SEQ ID NO: 2800 - RNA, 21 nt, Homo sapiens
gguagauuuuccuucuauggu

SEQ ID NO: 2801 - RNA, 21 nt, Homo sapiens
accauagaaggaaaaucuacc

SEQ ID NO: 2802 - RNA, 21 nt, Homo sapiens
aucauagaggaaaauccacgu

SEQ ID NO: 2803 - RNA, 21 nt, Homo sapiens
acguggauuuuccucuaugau

SEQ ID NO: 2804 - RNA, 22 nt, Homo sapiens
guagauucuccuucuaugagua

SEQ ID NO: 2805 - RNA, 22 nt, Homo sapiens
uacucauagaaggagaaucuac

SEQ ID NO: 2806 - RNA, 22 nt, Homo sapiens
cugguacaggccugggggacag

SEQ ID NO: 2807 - RNA, 22 nt, Homo sapiens
cugucccccaggccuguaccag

SEQ ID NO: 2808 - RNA, 22 nt, Homo sapiens
ucucccaacccuuguaccagug

SEQ ID NO: 2809 - RNA, 22 nt, Homo sapiens
cacugguacaaggguugggaga

SEQ ID NO: 2810 - RNA, 22 nt, Homo sapiens
acggguuaggcucuugggagcu

SEQ ID NO: 2811 - RNA, 22 nt, Homo sapiens
agcucccaagagccuaacccgu

SEQ ID NO: 2812 - RNA, 22 nt, Homo sapiens
ucacaagucaggcucuugggac

SEQ ID NO: 2813 - RNA, 22 nt, Homo sapiens
gucccaagagccugacuuguga

SEQ ID NO: 2814 - RNA, 22 nt, Homo sapiens
aacccguagauccgaacuugug

SEQ ID NO: 2815 - RNA, 22 nt, Homo sapiens
cacaaguucggaucuacggguu

SEQ ID NO: 2816 - RNA, 21 nt, Homo sapiens
cuguacaggccacugccuugc

SEQ ID NO: 2817 - RNA, 21 nt, Homo sapiens
gcaaggcaguggccuguacag

SEQ ID NO: 2818 - RNA, 22 nt, Homo sapiens
ugagguaguaguuuguacaguu

SEQ ID NO: 2819 - RNA, 22 nt, Homo sapiens
aacuguacaaacuacuaccuca

SEQ ID NO: 2820 - RNA, 22 nt, Homo sapiens
ucccugagacccuaacuuguga

SEQ ID NO: 2821 - RNA, 22 nt, Homo sapiens
ucacaaguuagggucucaggga

SEQ ID NO: 2822 - RNA, 22 nt, Homo sapiens
caagcuuguaucuauagguaug

SEQ ID NO: 2823 - RNA, 22 nt, Homo sapiens
cauaccuauagauacaagcuug

SEQ ID NO: 2824 - RNA, 23 nt, Homo sapiens
aaagugcugcgacauuugagcgu

SEQ ID NO: 2825 - RNA, 23 nt, Homo sapiens
acgcucaaaugucgcagcacuuu

SEQ ID NO: 2826 - RNA, 22 nt, Homo sapiens
uuuagagacggggucuugcucu

SEQ ID NO: 2827 - RNA, 22 nt, Homo sapiens
agagcaagaccccgucucuaaa

SEQ ID NO: 2828 - RNA, 24 nt, Homo sapiens
uggcccugacugaagaccagcagu

SEQ ID NO: 2829 - RNA, 24 nt, Homo sapiens
acugcuggucuucagucagggcca

SEQ ID NO: 2830 - RNA, 21 nt, Homo sapiens
gcgacccauacuugguuucag

SEQ ID NO: 2831 - RNA, 21 nt, Homo sapiens
cugaaaccaaguaugggucgc

SEQ ID NO: 2832 - RNA, 22 nt, Homo sapiens
gaaaucaagcgugggugagacc

SEQ ID NO: 2833 - RNA, 22 nt, Homo sapiens
ggucucacccacgcuugauuuc

SEQ ID NO: 2834 - RNA, 21 nt, Homo sapiens
cccugggccucugcuccccag

SEQ ID NO: 2835 - RNA, 21 nt, Homo sapiens
cuggggagcagaggcccaggg

SEQ ID NO: 2836 - RNA, 24 nt, Homo sapiens
uggggagcugaggcucugggggug

SEQ ID NO: 2837 - RNA, 24 nt, Homo sapiens
cacccccagagccucagcucccca

SEQ ID NO: 2838 - RNA, 20 nt, Homo sapiens
ggggagcuguggaagcagua

SEQ ID NO: 2839 - RNA, 20 nt, Homo sapiens
uacugcuuccacagcucccc

SEQ ID NO: 2840 - RNA, 25 nt, Homo sapiens
cuagugagggacagaaccaggauuc

SEQ ID NO: 2841 - RNA, 25 nt, Homo sapiens
gaauccugguucugucccucacuag

SEQ ID NO: 2842 - RNA, 20 nt, Homo sapiens
agagucuugugaugucuugc

SEQ ID NO: 2843 - RNA, 20 nt, Homo sapiens
gcaagacaucacaagacucu

SEQ ID NO: 2844 - RNA, 23 nt, Homo sapiens
gcagcagagaauaggacuacguc

SEQ ID NO: 2845 - RNA, 23 nt, Homo sapiens
gacguaguccuauucucugcugc

SEQ ID NO: 2846 - RNA, 23 nt, Homo sapiens
ugagcgccucgacgacagagccg

SEQ ID NO: 2847 - RNA, 23 nt, Homo sapiens
cggcucugucgucgaggcgcuca

SEQ ID NO: 2848 - RNA, 23 nt, Homo sapiens
ucccuguccuccaggagcucacg

SEQ ID NO: 2849 - RNA, 23 nt, Homo sapiens
cgugagcuccuggaggacaggga

SEQ ID NO: 2850 - RNA, 22 nt, Homo sapiens
cuauacggccuccuagcuuucc

SEQ ID NO: 2851 - RNA, 22 nt, Homo sapiens
ggaaagcuaggaggccguauag

SEQ ID NO: 2852 - RNA, 22 nt, Homo sapiens
ugagguaggagguuguauaguu

SEQ ID NO: 2853 - RNA, 22 nt, Homo sapiens
aacuauacaaccuccuaccuca

SEQ ID NO: 2854 - RNA, 22 nt, Homo sapiens
cugcgcaagcuacugccuugcu

SEQ ID NO: 2855 - RNA, 22 nt, Homo sapiens
agcaaggcaguagcuugcgcag

SEQ ID NO: 2856 - RNA, 22 nt, Homo sapiens
ugagguaguaguuugugcuguu

SEQ ID NO: 2857 - RNA, 22 nt, Homo sapiens
aacagcacaaacuacuaccuca

SEQ ID NO: 2858 - RNA, 22 nt, Homo sapiens
ugcccuguggacucaguucugg

SEQ ID NO: 2859 - RNA, 22 nt, Homo sapiens
ccagaacugaguccacagggca

SEQ ID NO: 2860 - RNA, 21 nt, Homo sapiens
ugguucuagacuugccaacua

SEQ ID NO: 2861 - RNA, 21 nt, Homo sapiens
uaguuggcaagucuagaacca

SEQ ID NO: 2862 - RNA, 23 nt, Homo sapiens
ugucugcccgcaugccugccucu

SEQ ID NO: 2863 - RNA, 23 nt, Homo sapiens
agaggcaggcaugcgggcagaca

SEQ ID NO: 2864 - RNA, 22 nt, Homo sapiens
aaaaguaauugcggucuuuggu

SEQ ID NO: 2865 - RNA, 22 nt, Homo sapiens
accaaagaccgcaauuacuuuu

SEQ ID NO: 2866 - RNA, 18 nt, Homo sapiens
ucgaggagcucacagucu

SEQ ID NO: 2867 - RNA, 18 nt, Homo sapiens
agacugugagcuccucga

SEQ ID NO: 2868 - RNA, 22 nt, Homo sapiens
cuauacaaucuauugccuuccc

SEQ ID NO: 2869 - RNA, 22 nt, Homo sapiens
gggaaggcaauagauuguauag

SEQ ID NO: 2870 - RNA, 22 nt, Homo sapiens
cuauacagucuacugucuuucc

SEQ ID NO: 2871 - RNA, 22 nt, Homo sapiens
ggaaagacaguagacuguauag

SEQ ID NO: 2872 - RNA, 22 nt, Homo sapiens
ugagguaguagauuguauaguu

SEQ ID NO: 2873 - RNA, 22 nt, Homo sapiens
aacuauacaaucuacuaccuca

SEQ ID NO: 2874 - RNA, 22 nt, Homo sapiens
aaaaguaauugugguuuuggcc

SEQ ID NO: 2875 - RNA, 22 nt, Homo sapiens
ggccaaaaccacaauuacuuuu

SEQ ID NO: 2876 - RNA, 22 nt, Homo sapiens
aaaaguaauugcgguuuuugcc

SEQ ID NO: 2877 - RNA, 22 nt, Homo sapiens
ggcaaaaaccgcaauuacuuuu

SEQ ID NO: 2878 - RNA, 22 nt, Homo sapiens
ccucugaaauucaguucuucag

SEQ ID NO: 2879 - RNA, 22 nt, Homo sapiens
cugaagaacugaauuucagagg

SEQ ID NO: 2880 - RNA, 22 nt, Homo sapiens
ugagaacugaauuccauggguu

SEQ ID NO: 2881 - RNA, 22 nt, Homo sapiens
aacccauggaauucaguucuca

SEQ ID NO: 2882 - RNA, 22 nt, Homo sapiens
acagcaggcacagacaggcagu

SEQ ID NO: 2883 - RNA, 22 nt, Homo sapiens
acugccugucugugccugcugu

SEQ ID NO: 2884 - RNA, 22 nt, Homo sapiens
ugccugucuacacuugcugugc

SEQ ID NO: 2885 - RNA, 22 nt, Homo sapiens
gcacagcaaguguagacaggca

SEQ ID NO: 2886 - RNA, 22 nt, Homo sapiens
uagcaccaucugaaaucgguua

SEQ ID NO: 2887 - RNA, 22 nt, Homo sapiens
uaaccgauuucagauggugcua

SEQ ID NO: 2888 - RNA, 22 nt, Homo sapiens
acugauuucuuuugguguucag

SEQ ID NO: 2889 - RNA, 22 nt, Homo sapiens
cugaacaccaaaagaaaucagu

SEQ ID NO: 2890 - RNA, 24 nt, Homo sapiens
gcugguuucauauggugguuuaga

SEQ ID NO: 2891 - RNA, 24 nt, Homo sapiens
ucuaaaccaccauaugaaaccagc

SEQ ID NO: 2892 - RNA, 22 nt, Homo sapiens
cugguuucacaugguggcuuag

SEQ ID NO: 2893 - RNA, 22 nt, Homo sapiens
cuaagccaccaugugaaaccag

SEQ ID NO: 2894 - RNA, 23 nt, Homo sapiens
uagcaccauuugaaaucaguguu

SEQ ID NO: 2895 - RNA, 23 nt, Homo sapiens
aacacugauuucaaauggugcua

SEQ ID NO: 2896 - RNA, 22 nt, Homo sapiens
uagcaccauuugaaaucgguua

SEQ ID NO: 2897 - RNA, 22 nt, Homo sapiens
uaaccgauuucaaauggugcua

SEQ ID NO: 2898 - RNA, 22 nt, Homo sapiens
ugaccgauuucuccugguguuc

SEQ ID NO: 2899 - RNA, 22 nt, Homo sapiens
gaacaccaggagaaaucgguca

SEQ ID NO: 2900 - RNA, 23 nt, Homo sapiens
ugucacucggcucggcccacuac

SEQ ID NO: 2901 - RNA, 23 nt, Homo sapiens
guagugggccgagccgagugaca

SEQ ID NO: 2902 - RNA, 22 nt, Homo sapiens
cugccaauuccauaggucacag

SEQ ID NO: 2903 - RNA, 22 nt, Homo sapiens
cugugaccuauggaauuggcag

SEQ ID NO: 2904 - RNA, 21 nt, Homo sapiens
cugaccuaugaauugacagcc

SEQ ID NO: 2905 - RNA, 21 nt, Homo sapiens
ggcugucaauucauaggucag

SEQ ID NO: 2906 - RNA, 20 nt, Homo sapiens
acugccccaggugcugcugg

SEQ ID NO: 2907 - RNA, 20 nt, Homo sapiens
ccagcagcaccuggggcagu

SEQ ID NO: 2908 - RNA, 22 nt, Homo sapiens
aacgccauuaucacacuaaaua

SEQ ID NO: 2909 - RNA, 22 nt, Homo sapiens
uauuuagugugauaauggcguu

SEQ ID NO: 2910 - RNA, 22 nt, Homo sapiens
cuuucagucggauguuugcagc

SEQ ID NO: 2911 - RNA, 22 nt, Homo sapiens
gcugcaaacauccgacugaaag

SEQ ID NO: 2912 - RNA, 22 nt, Homo sapiens
aauugcacgguauccaucugua

SEQ ID NO: 2913 - RNA, 22 nt, Homo sapiens
uacagauggauaccgugcaauu

SEQ ID NO: 2914 - RNA, 22 nt, Homo sapiens
cggguggaucacgaugcaauuu

SEQ ID NO: 2915 - RNA, 22 nt, Homo sapiens
aaauugcaucgugauccacccg

SEQ ID NO: 2916 - RNA, 22 nt, Homo sapiens
cugggagguggauguuuacuuc

SEQ ID NO: 2917 - RNA, 22 nt, Homo sapiens
gaaguaaacauccaccucccag

SEQ ID NO: 2918 - RNA, 22 nt, Homo sapiens
uguaaacauccuacacucagcu

SEQ ID NO: 2919 - RNA, 22 nt, Homo sapiens
agcugaguguaggauguuuaca

SEQ ID NO: 2920 - RNA, 22 nt, Homo sapiens
cugggagaggguuguuuacucc

SEQ ID NO: 2921 - RNA, 22 nt, Homo sapiens
ggaguaaacaacccucucccag

SEQ ID NO: 2922 - RNA, 22 nt, Homo sapiens
cugggagaaggcuguuuacucu

SEQ ID NO: 2923 - RNA, 22 nt, Homo sapiens
agaguaaacagccuucucccag

SEQ ID NO: 2924 - RNA, 23 nt, Homo sapiens
uguaaacauccuacacucucagc

SEQ ID NO: 2925 - RNA, 23 nt, Homo sapiens
gcugagaguguaggauguuuaca

SEQ ID NO: 2926 - RNA, 22 nt, Homo sapiens
uuuuucauuauugcuccugacc

SEQ ID NO: 2927 - RNA, 22 nt, Homo sapiens
ggucaggagcaauaaugaaaaa

SEQ ID NO: 2928 - RNA, 23 nt, Homo sapiens
ucaagagcaauaacgaaaaaugu

SEQ ID NO: 2929 - RNA, 23 nt, Homo sapiens
acauuuuucguuauugcucuuga

SEQ ID NO: 2930 - RNA, 23 nt, Homo sapiens
caaagugcuuacagugcagguag

SEQ ID NO: 2931 - RNA, 23 nt, Homo sapiens
cuaccugcacuguaagcacuuug

SEQ ID NO: 2932 - RNA, 22 nt, Homo sapiens
ggauuccuggaaauacuguucu

SEQ ID NO: 2933 - RNA, 22 nt, Homo sapiens
agaacaguauuuccaggaaucc

SEQ ID NO: 2934 - RNA, 23 nt, Homo sapiens
guccaguuuucccaggaaucccu

SEQ ID NO: 2935 - RNA, 23 nt, Homo sapiens
agggauuccugggaaaacuggac

SEQ ID NO: 2936 - RNA, 22 nt, Homo sapiens
acugcauuaugagcacuuaaag

SEQ ID NO: 2937 - RNA, 22 nt, Homo sapiens
cuuuaagugcucauaaugcagu

SEQ ID NO: 2938 - RNA, 23 nt, Homo sapiens
uaaagugcuuauagugcagguag

SEQ ID NO: 2939 - RNA, 23 nt, Homo sapiens
cuaccugcacuauaagcacuuua

SEQ ID NO: 2940 - RNA, 22 nt, Homo sapiens
gaggguuggguggaggcucucc

SEQ ID NO: 2941 - RNA, 22 nt, Homo sapiens
ggagagccuccacccaacccuc

SEQ ID NO: 2942 - RNA, 22 nt, Homo sapiens
cugugcgugugacagcggcuga

SEQ ID NO: 2943 - RNA, 22 nt, Homo sapiens
ucagccgcugucacacgcacag

SEQ ID NO: 2944 - RNA, 22 nt, Homo sapiens
ccaguggggcugcuguuaucug

SEQ ID NO: 2945 - RNA, 22 nt, Homo sapiens
cagauaacagcagccccacugg

SEQ ID NO: 2946 - RNA, 22 nt, Homo sapiens
uguaacagcaacuccaugugga

SEQ ID NO: 2947 - RNA, 22 nt, Homo sapiens
uccacauggaguugcuguuaca

SEQ ID NO: 2948 - RNA, 22 nt, Homo sapiens
ucacaguggucucugggauuau

SEQ ID NO: 2949 - RNA, 22 nt, Homo sapiens
auaaucccagagaccacuguga

SEQ ID NO: 2950 - RNA, 22 nt, Homo sapiens
uaaucucagcuggcaacuguga

SEQ ID NO: 2951 - RNA, 22 nt, Homo sapiens
ucacaguugccagcugagauua

SEQ ID NO: 2952 - RNA, 22 nt, Homo sapiens
cagugccucggcagugcagccc

SEQ ID NO: 2953 - RNA, 22 nt, Homo sapiens
gggcugcacugccgaggcacug

SEQ ID NO: 2954 - RNA, 20 nt, Homo sapiens
gugcauugcuguugcauugc

SEQ ID NO: 2955 - RNA, 20 nt, Homo sapiens
gcaaugcaacagcaaugcac

SEQ ID NO: 2956 - RNA, 19 nt, Homo sapiens
acuggacuuggaggcagaa

SEQ ID NO: 2957 - RNA, 19 nt, Homo sapiens
uucugccuccaaguccagu

SEQ ID NO: 2958 - RNA, 25 nt, Homo sapiens
acuggacuuggagucagaagagugg

SEQ ID NO: 2959 - RNA, 25 nt, Homo sapiens
ccacucuucugacuccaaguccagu

SEQ ID NO: 2960 - RNA, 20 nt, Homo sapiens
acuggacuuggagucagaaa

SEQ ID NO: 2961 - RNA, 20 nt, Homo sapiens
uuucugacuccaaguccagu

SEQ ID NO: 2962 - RNA, 19 nt, Homo sapiens
acuggacuuggagucagga

SEQ ID NO: 2963 - RNA, 19 nt, Homo sapiens
uccugacuccaaguccagu

SEQ ID NO: 2964 - RNA, 20 nt, Homo sapiens
acuggacuuggagccagaag

SEQ ID NO: 2965 - RNA, 20 nt, Homo sapiens
cuucuggcuccaaguccagu

SEQ ID NO: 2966 - RNA, 20 nt, Homo sapiens
acugggcuuggagucagaag

SEQ ID NO: 2967 - RNA, 20 nt, Homo sapiens
cuucugacuccaagcccagu

SEQ ID NO: 2968 - RNA, 21 nt, Homo sapiens
acuggacuuggugucagaugg

SEQ ID NO: 2969 - RNA, 21 nt, Homo sapiens
ccaucugacaccaaguccagu

SEQ ID NO: 2970 - RNA, 21 nt, Homo sapiens
acuggacuaggagucagaagg

SEQ ID NO: 2971 - RNA, 21 nt, Homo sapiens
ccuucugacuccuaguccagu

SEQ ID NO: 2972 - RNA, 19 nt, Homo sapiens
acuggauuuggagccagaa

SEQ ID NO: 2973 - RNA, 19 nt, Homo sapiens
uucuggcuccaaauccagu

SEQ ID NO: 2974 - RNA, 20 nt, Homo sapiens
aggaauguuccuucuuugcc

SEQ ID NO: 2975 - RNA, 20 nt, Homo sapiens
ggcaaagaaggaacauuccu

SEQ ID NO: 2976 - RNA, 21 nt, Homo sapiens
ucagugcaugacagaacuugg

SEQ ID NO: 2977 - RNA, 21 nt, Homo sapiens
ccaaguucugucaugcacuga

SEQ ID NO: 2978 - RNA, 20 nt, Homo sapiens
ucacaccugccucgcccccc

SEQ ID NO: 2979 - RNA, 20 nt, Homo sapiens
ggggggcgaggcagguguga

SEQ ID NO: 2980 - RNA, 21 nt, Homo sapiens
gugggcgggggcaggugugug

SEQ ID NO: 2981 - RNA, 21 nt, Homo sapiens
cacacaccugcccccgcccac

SEQ ID NO: 2982 - RNA, 22 nt, Homo sapiens
acgcccuucccccccuucuuca

SEQ ID NO: 2983 - RNA, 22 nt, Homo sapiens
ugaagaagggggggaagggcgu

SEQ ID NO: 2984 - RNA, 22 nt, Homo sapiens
uugcauauguaggaugucccau

SEQ ID NO: 2985 - RNA, 22 nt, Homo sapiens
augggacauccuacauaugcaa

SEQ ID NO: 2986 - RNA, 23 nt, Homo sapiens
guuugcacgggugggccuugucu

SEQ ID NO: 2987 - RNA, 23 nt, Homo sapiens
agacaaggcccacccgugcaaac

SEQ ID NO: 2988 - RNA, 22 nt, Homo sapiens
gacuauagaacuuucccccuca

SEQ ID NO: 2989 - RNA, 22 nt, Homo sapiens
ugagggggaaaguucuauaguc

SEQ ID NO: 2990 - RNA, 21 nt, Homo sapiens
agggggaaaguucuauagucc

SEQ ID NO: 2991 - RNA, 21 nt, Homo sapiens
ggacuauagaacuuucccccu

SEQ ID NO: 2992 - RNA, 21 nt, Homo sapiens
cuuuuugcggucugggcuugc

SEQ ID NO: 2993 - RNA, 21 nt, Homo sapiens
gcaagcccagaccgcaaaaag

SEQ ID NO: 2994 - RNA, 21 nt, Homo sapiens
ucuuguguucucuagaucagu

SEQ ID NO: 2995 - RNA, 21 nt, Homo sapiens
acugaucuagagaacacaaga

SEQ ID NO: 2996 - RNA, 23 nt, Homo sapiens
cccaguguucagacuaccuguuc

SEQ ID NO: 2997 - RNA, 23 nt, Homo sapiens
gaacagguagucugaacacuggg

SEQ ID NO: 2998 - RNA, 22 nt, Homo sapiens
acaguagucugcacauugguua

SEQ ID NO: 2999 - RNA, 22 nt, Homo sapiens
uaaccaaugugcagacuacugu

SEQ ID NO: 3000 - RNA, 22 nt, Homo sapiens
acaguagucugcacauugguua

SEQ ID NO: 3001 - RNA, 22 nt, Homo sapiens
uaaccaaugugcagacuacugu

SEQ ID NO: 3002 - RNA, 23 nt, Homo sapiens
cccaguguuuagacuaucuguuc

SEQ ID NO: 3003 - RNA, 23 nt, Homo sapiens
gaacagauagucuaaacacuggg

SEQ ID NO: 3004 - RNA, 22 nt, Homo sapiens
uggagugugacaaugguguuug

SEQ ID NO: 3005 - RNA, 22 nt, Homo sapiens
caaacaccauugucacacucca

SEQ ID NO: 3006 - RNA, 22 nt, Homo sapiens
ugcccuaaaugccccuucuggc

SEQ ID NO: 3007 - RNA, 22 nt, Homo sapiens
gccagaaggggcauuuagggca

SEQ ID NO: 3008 - RNA, 23 nt, Homo sapiens
uaaggugcaucuagugcaguuag

SEQ ID NO: 3009 - RNA, 23 nt, Homo sapiens
cuaacugcacuagaugcaccuua

SEQ ID NO: 3010 - RNA, 22 nt, Homo sapiens
cuccuauaugaugccuuucuuc

SEQ ID NO: 3011 - RNA, 22 nt, Homo sapiens
gaagaaaggcaucauauaggag

SEQ ID NO: 3012 - RNA, 21 nt, Homo sapiens
gaacggcuucauacaggaguu

SEQ ID NO: 3013 - RNA, 21 nt, Homo sapiens
aacuccuguaugaagccguuc

SEQ ID NO: 3014 - RNA, 22 nt, Homo sapiens
ugugacugguugaccagagggg

SEQ ID NO: 3015 - RNA, 22 nt, Homo sapiens
ccccucuggucaaccagucaca

SEQ ID NO: 3016 - RNA, 23 nt, Homo sapiens
acugcccuaagugcuccuucugg

SEQ ID NO: 3017 - RNA, 23 nt, Homo sapiens
ccagaaggagcacuuagggcagu

SEQ ID NO: 3018 - RNA, 23 nt, Homo sapiens
uaaggugcaucuagugcagauag

SEQ ID NO: 3019 - RNA, 23 nt, Homo sapiens
cuaucugcacuagaugcaccuua

SEQ ID NO: 3020 - RNA, 22 nt, Homo sapiens
cagugcaaugaugaaagggcau

SEQ ID NO: 3021 - RNA, 22 nt, Homo sapiens
augcccuuucaucauugcacug

SEQ ID NO: 3022 - RNA, 21 nt, Homo sapiens
acucuuucccuguugcacuac

SEQ ID NO: 3023 - RNA, 21 nt, Homo sapiens
guagugcaacagggaaagagu

SEQ ID NO: 3024 - RNA, 24 nt, Homo sapiens
uuuggcaaugguagaacucacacu

SEQ ID NO: 3025 - RNA, 24 nt, Homo sapiens
agugugaguucuaccauugccaaa

SEQ ID NO: 3026 - RNA, 21 nt, Homo sapiens
agggcccccccucaauccugu

SEQ ID NO: 3027 - RNA, 21 nt, Homo sapiens
acaggauugagggggggcccu

SEQ ID NO: 3028 - RNA, 22 nt, Homo sapiens
cagugcaauguuaaaagggcau

SEQ ID NO: 3029 - RNA, 22 nt, Homo sapiens
augcccuuuuaacauugcacug

SEQ ID NO: 3030 - RNA, 22 nt, Homo sapiens
uucacauugugcuacugucugc

SEQ ID NO: 3031 - RNA, 22 nt, Homo sapiens
gcagacaguagcacaaugugaa

SEQ ID NO: 3032 - RNA, 22 nt, Homo sapiens
ucggauccgucugagcuuggcu

SEQ ID NO: 3033 - RNA, 22 nt, Homo sapiens
agccaagcucagacggauccga

SEQ ID NO: 3034 - RNA, 22 nt, Homo sapiens
cugaagcucagagggcucugau

SEQ ID NO: 3035 - RNA, 22 nt, Homo sapiens
aucagagcccucugagcuucag

SEQ ID NO: 3036 - RNA, 22 nt, Homo sapiens
ccucuuccccuugucucuccag

SEQ ID NO: 3037 - RNA, 22 nt, Homo sapiens
cuggagagacaaggggaagagg

SEQ ID NO: 3038 - RNA, 22 nt, Homo sapiens
ugagugacaggggaaaugggga

SEQ ID NO: 3039 - RNA, 22 nt, Homo sapiens
uccccauuuccccugucacuca

SEQ ID NO: 3040 - RNA, 22 nt, Homo sapiens
ucaggacacuucugaacuugga

SEQ ID NO: 3041 - RNA, 22 nt, Homo sapiens
uccaaguucagaaguguccuga

SEQ ID NO: 3042 - RNA, 22 nt, Homo sapiens
caguucagaaguguuccugagu

SEQ ID NO: 3043 - RNA, 22 nt, Homo sapiens
acucaggaacacuucugaacug

SEQ ID NO: 3044 - RNA, 21 nt, Homo sapiens
uuucccuuuccauccuggcag

SEQ ID NO: 3045 - RNA, 21 nt, Homo sapiens
cugccaggauggaaagggaaa

SEQ ID NO: 3046 - RNA, 21 nt, Homo sapiens
uugccagggcaggagguggaa

SEQ ID NO: 3047 - RNA, 21 nt, Homo sapiens
uuccaccuccugcccuggcaa

SEQ ID NO: 3048 - RNA, 21 nt, Homo sapiens
agagauugguagaaaucaggu

SEQ ID NO: 3049 - RNA, 21 nt, Homo sapiens
accugauuucuaccaaucucu

SEQ ID NO: 3050 - RNA, 23 nt, Homo sapiens
aaucggacccauuuaaaccggag

SEQ ID NO: 3051 - RNA, 23 nt, Homo sapiens
cuccgguuuaaauggguccgauu

SEQ ID NO: 3052 - RNA, 24 nt, Homo sapiens
ucugggcacaggcggauggacagg

SEQ ID NO: 3053 - RNA, 24 nt, Homo sapiens
ccuguccauccgccugugcccaga

SEQ ID NO: 3054 - RNA, 21 nt, Homo sapiens
ccagugacugagcuggagcca

SEQ ID NO: 3055 - RNA, 21 nt, Homo sapiens
uggcuccagcucagucacugg

SEQ ID NO: 3056 - RNA, 22 nt, Homo sapiens
aggauaggaagaaugaagugcu

SEQ ID NO: 3057 - RNA, 22 nt, Homo sapiens
agcacuucauucuuccuauccu

SEQ ID NO: 3058 - RNA, 22 nt, Homo sapiens
aggagaguggauuccagguggu

SEQ ID NO: 3059 - RNA, 22 nt, Homo sapiens
accaccuggaauccacucuccu

SEQ ID NO: 3060 - RNA, 22 nt, Homo sapiens
uccuccucuaccucaucccagu

SEQ ID NO: 3061 - RNA, 22 nt, Homo sapiens
acugggaugagguagaggagga

SEQ ID NO: 3062 - RNA, 22 nt, Homo sapiens
ugagggguuuggaaugggaugg

SEQ ID NO: 3063 - RNA, 22 nt, Homo sapiens
ccaucccauuccaaaccccuca

SEQ ID NO: 3064 - RNA, 21 nt, Homo sapiens
auccaguucucugagggggcu

SEQ ID NO: 3065 - RNA, 21 nt, Homo sapiens
agcccccucagagaacuggau

SEQ ID NO: 3066 - RNA, 22 nt, Homo sapiens
aaccccuaaggcaacuggaugg

SEQ ID NO: 3067 - RNA, 22 nt, Homo sapiens
ccauccaguugccuuagggguu

SEQ ID NO: 3068 - RNA, 21 nt, Homo sapiens
ucauccucgucucccucccag

SEQ ID NO: 3069 - RNA, 21 nt, Homo sapiens
cugggagggagacgaggauga

SEQ ID NO: 3070 - RNA, 22 nt, Homo sapiens
agggaaggggacgaggguuggg

SEQ ID NO: 3071 - RNA, 22 nt, Homo sapiens
cccaacccucguccccuucccu

SEQ ID NO: 3072 - RNA, 23 nt, Homo sapiens
aagaagagacugagucaucgaau

SEQ ID NO: 3073 - RNA, 23 nt, Homo sapiens
auucgaugacucagucucuucuu

SEQ ID NO: 3074 - RNA, 23 nt, Homo sapiens
caauggcacaaacucauucuuga

SEQ ID NO: 3075 - RNA, 23 nt, Homo sapiens
ucaagaaugaguuugugccauug

SEQ ID NO: 3076 - RNA, 21 nt, Homo sapiens
acugaauccucuuuuccucag

SEQ ID NO: 3077 - RNA, 21 nt, Homo sapiens
cugaggaaaagaggauucagu

SEQ ID NO: 3078 - RNA, 22 nt, Homo sapiens
ugggaugagggauugaagugga

SEQ ID NO: 3079 - RNA, 22 nt, Homo sapiens
uccacuucaaucccucauccca

SEQ ID NO: 3080 - RNA, 22 nt, Homo sapiens
caggccauauugugcugccuca

SEQ ID NO: 3081 - RNA, 22 nt, Homo sapiens
ugaggcagcacaauauggccug

SEQ ID NO: 3082 - RNA, 22 nt, Homo sapiens
uagcagcacauaaugguuugug

SEQ ID NO: 3083 - RNA, 22 nt, Homo sapiens
cacaaaccauuaugugcugcua

SEQ ID NO: 3084 - RNA, 22 nt, Homo sapiens
cgaaucauuauuugcugcucua

SEQ ID NO: 3085 - RNA, 22 nt, Homo sapiens
uagagcagcaaauaaugauucg

SEQ ID NO: 3086 - RNA, 22 nt, Homo sapiens
uagcagcacaucaugguuuaca

SEQ ID NO: 3087 - RNA, 22 nt, Homo sapiens
uguaaaccaugaugugcugcua

SEQ ID NO: 3088 - RNA, 22 nt, Homo sapiens
ccaauauuacugugcugcuuua

SEQ ID NO: 3089 - RNA, 22 nt, Homo sapiens
uaaagcagcacaguaauauugg

SEQ ID NO: 3090 - RNA, 22 nt, Homo sapiens
cuagguauggucccagggaucc

SEQ ID NO: 3091 - RNA, 22 nt, Homo sapiens
ggaucccugggaccauaccuag

SEQ ID NO: 3092 - RNA, 20 nt, Homo sapiens
guguguggaaaugcuucugc

SEQ ID NO: 3093 - RNA, 20 nt, Homo sapiens
gcagaagcauuuccacacac

SEQ ID NO: 3094 - RNA, 22 nt, Homo sapiens
gugugcggaaaugcuucugcua

SEQ ID NO: 3095 - RNA, 22 nt, Homo sapiens
uagcagaagcauuuccgcacac

SEQ ID NO: 3096 - RNA, 23 nt, Homo sapiens
agcagcauuguacagggcuauca

SEQ ID NO: 3097 - RNA, 23 nt, Homo sapiens
ugauagcccuguacaaugcugcu

SEQ ID NO: 3098 - RNA, 22 nt, Homo sapiens
aacuggcccucaaagucccgcu

SEQ ID NO: 3099 - RNA, 22 nt, Homo sapiens
agcgggacuuugagggccaguu

SEQ ID NO: 3100 - RNA, 22 nt, Homo sapiens
cgggguuuugagggcgagauga

SEQ ID NO: 3101 - RNA, 22 nt, Homo sapiens
ucaucucgcccucaaaaccccg

SEQ ID NO: 3102 - RNA, 21 nt, Homo sapiens
gcagggacagcaaaggggugc

SEQ ID NO: 3103 - RNA, 21 nt, Homo sapiens
gcaccccuuugcugucccugc

SEQ ID NO: 3104 - RNA, 22 nt, Homo sapiens
uucccuuugucauccuucgccu

SEQ ID NO: 3105 - RNA, 22 nt, Homo sapiens
aggcgaaggaugacaaagggaa

SEQ ID NO: 3106 - RNA, 23 nt, Homo sapiens
auggccaaaacugcaguuauuuu

SEQ ID NO: 3107 - RNA, 23 nt, Homo sapiens
aaaauaacugcaguuuuggccau

SEQ ID NO: 3108 - RNA, 25 nt, Homo sapiens
aaaaaccacaauuacuuuugcacca

SEQ ID NO: 3109 - RNA, 25 nt, Homo sapiens
uggugcaaaaguaauugugguuuuu

SEQ ID NO: 3110 - RNA, 21 nt, Homo sapiens
caaaagugaucgugguuuuug

SEQ ID NO: 3111 - RNA, 21 nt, Homo sapiens
caaaaaccacgaucacuuuug

SEQ ID NO: 3112 - RNA, 23 nt, Homo sapiens
caaagacugcaauuacuuuugcg

SEQ ID NO: 3113 - RNA, 23 nt, Homo sapiens
cgcaaaaguaauugcagucuuug

SEQ ID NO: 3114 - RNA, 23 nt, Homo sapiens
aaaaguaacugcgguuuuugccu

SEQ ID NO: 3115 - RNA, 23 nt, Homo sapiens
aggcaaaaaccgcaguuacuuuu

SEQ ID NO: 3116 - RNA, 22 nt, Homo sapiens
ugccuggaacauaguagggacu

SEQ ID NO: 3117 - RNA, 22 nt, Homo sapiens
agucccuacuauguuccaggca

SEQ ID NO: 3118 - RNA, 21 nt, Homo sapiens
auaggacucauauagugccag

SEQ ID NO: 3119 - RNA, 21 nt, Homo sapiens
cuggcacuauaugaguccuau

SEQ ID NO: 3120 - RNA, 20 nt, Homo sapiens
agacacuauacgagucauau

SEQ ID NO: 3121 - RNA, 20 nt, Homo sapiens
auaugacucguauagugucu

SEQ ID NO: 3122 - RNA, 23 nt, Homo sapiens
ugugacugcauuaugaaaauucu

SEQ ID NO: 3123 - RNA, 23 nt, Homo sapiens
agaauuuucauaaugcagucaca

SEQ ID NO: 3124 - RNA, 20 nt, Homo sapiens
uggcuuuuaacuuugauggc

SEQ ID NO: 3125 - RNA, 20 nt, Homo sapiens
gccaucaaaguuaaaagcca

SEQ ID NO: 3126 - RNA, 21 nt, Homo sapiens
cacagcaaguguagacaggca

SEQ ID NO: 3127 - RNA, 21 nt, Homo sapiens
ugccugucuacacuugcugug

SEQ ID NO: 3128 - RNA, 21 nt, Homo sapiens
ccugucugugccugcuguaca

SEQ ID NO: 3129 - RNA, 21 nt, Homo sapiens
uguacagcaggcacagacagg

SEQ ID NO: 3130 - RNA, 22 nt, Homo sapiens
uaaauagaguaggcaaaggaca

SEQ ID NO: 3131 - RNA, 22 nt, Homo sapiens
uguccuuugccuacucuauuua

SEQ ID NO: 3132 - RNA, 22 nt, Homo sapiens
uccuuugccuauucuauuuaag

SEQ ID NO: 3133 - RNA, 22 nt, Homo sapiens
cuuaaauagaauaggcaaagga

SEQ ID NO: 3134 - RNA, 22 nt, Homo sapiens
guugggacaagaggacggucuu

SEQ ID NO: 3135 - RNA, 22 nt, Homo sapiens
aagaccguccucuugucccaac

SEQ ID NO: 3136 - RNA, 17 nt, Homo sapiens
cagagaauuguuuaauc

SEQ ID NO: 3137 - RNA, 17 nt, Homo sapiens
gauuaaacaauucucug

SEQ ID NO: 3138 - RNA, 20 nt, Homo sapiens
uagaggaagcuguggagaga

SEQ ID NO: 3139 - RNA, 20 nt, Homo sapiens
ucucuccacagcuuccucua

SEQ ID NO: 3140 - RNA, 22 nt, Homo sapiens
uccccuucugcaggccugcugg

SEQ ID NO: 3141 - RNA, 22 nt, Homo sapiens
ccagcaggccugcagaagggga

SEQ ID NO: 3142 - RNA, 23 nt, Homo sapiens
aucagggcuuguggaaugggaag

SEQ ID NO: 3143 - RNA, 23 nt, Homo sapiens
cuucccauuccacaagcccugau

SEQ ID NO: 3144 - RNA, 23 nt, Homo sapiens
ucuggcaaguaaaaaacucucau

SEQ ID NO: 3145 - RNA, 23 nt, Homo sapiens
augagaguuuuuuacuugccaga

SEQ ID NO: 3146 - RNA, 23 nt, Homo sapiens
ucgaggacugguggaagggccuu

SEQ ID NO: 3147 - RNA, 23 nt, Homo sapiens
aaggcccuuccaccaguccucga

SEQ ID NO: 3148 - RNA, 24 nt, Homo sapiens
uggguagagaaggagcucagagga

SEQ ID NO: 3149 - RNA, 24 nt, Homo sapiens
uccucugagcuccuucucuaccca

SEQ ID NO: 3150 - RNA, 22 nt, Homo sapiens
uaaagaacucuuaaaacccaau

SEQ ID NO: 3151 - RNA, 22 nt, Homo sapiens
auuggguuuuaagaguucuuua

SEQ ID NO: 3152 - RNA, 23 nt, Homo sapiens
ugauggauaaaagacuacauauu

SEQ ID NO: 3153 - RNA, 23 nt, Homo sapiens
aauauguagucuuuuauccauca

SEQ ID NO: 3154 - RNA, 22 nt, Homo sapiens
ugccuaggcugagacugcagug

SEQ ID NO: 3155 - RNA, 22 nt, Homo sapiens
cacugcagucucagccuaggca

SEQ ID NO: 3156 - RNA, 22 nt, Homo sapiens
uggcccaaccuauucaguuagu

SEQ ID NO: 3157 - RNA, 22 nt, Homo sapiens
acuaacugaauagguugggcca

SEQ ID NO: 3158 - RNA, 23 nt, Homo sapiens
cugacugaauagguagggucauu

SEQ ID NO: 3159 - RNA, 23 nt, Homo sapiens
aaugacccuaccuauucagucag

SEQ ID NO: 3160 - RNA, 24 nt, Homo sapiens
ucuguagccugggagcaauggggu

SEQ ID NO: 3161 - RNA, 24 nt, Homo sapiens
accccauugcucccaggcuacaga

SEQ ID NO: 3162 - RNA, 23 nt, Homo sapiens
uaggagcucaacagaugccuguu

SEQ ID NO: 3163 - RNA, 23 nt, Homo sapiens
aacaggcaucuguugagcuccua

SEQ ID NO: 3164 - RNA, 19 nt, Homo sapiens
gagggcggguggaggagga

SEQ ID NO: 3165 - RNA, 19 nt, Homo sapiens
uccuccuccacccgcccuc

SEQ ID NO: 3166 - RNA, 25 nt, Homo sapiens
auaacauuguaaagcgcuucuuucg

SEQ ID NO: 3167 - RNA, 25 nt, Homo sapiens
cgaaagaagcgcuuuacaauguuau

SEQ ID NO: 3168 - RNA, 24 nt, Homo sapiens
agauauuuugaguguuuggaauug

SEQ ID NO: 3169 - RNA, 24 nt, Homo sapiens
caauuccaaacacucaaaauaucu

SEQ ID NO: 3170 - RNA, 22 nt, Homo sapiens
aacuccaaacacucaaaacuca

SEQ ID NO: 3171 - RNA, 22 nt, Homo sapiens
ugaguuuugaguguuuggaguu

SEQ ID NO: 3172 - RNA, 22 nt, Homo sapiens
caugcuaggauagaaagaaugg

SEQ ID NO: 3173 - RNA, 22 nt, Homo sapiens
ccauucuuucuauccuagcaug

SEQ ID NO: 3174 - RNA, 24 nt, Homo sapiens
gguugggcagugaggaggguguga

SEQ ID NO: 3175 - RNA, 24 nt, Homo sapiens
ucacacccuccucacugcccaacc

SEQ ID NO: 3176 - RNA, 22 nt, Homo sapiens
uggaaaaaacuggugugugcuu

SEQ ID NO: 3177 - RNA, 22 nt, Homo sapiens
aagcacacaccaguuuuuucca

SEQ ID NO: 3178 - RNA, 22 nt, Homo sapiens
cuggggagauccucgagguugg

SEQ ID NO: 3179 - RNA, 22 nt, Homo sapiens
ccaaccucgaggaucuccccag

SEQ ID NO: 3180 - RNA, 22 nt, Homo sapiens
caaccucgacgaucuccucagc

SEQ ID NO: 3181 - RNA, 22 nt, Homo sapiens
gcugaggagaucgucgagguug

SEQ ID NO: 3182 - RNA, 21 nt, Homo sapiens
ugaggagaucgucgagguugg

SEQ ID NO: 3183 - RNA, 21 nt, Homo sapiens
ccaaccucgacgaucuccuca

SEQ ID NO: 3184 - RNA, 22 nt, Homo sapiens
caaccucgaggaucuccccagc

SEQ ID NO: 3185 - RNA, 22 nt, Homo sapiens
gcuggggagauccucgagguug

SEQ ID NO: 3186 - RNA, 21 nt, Homo sapiens
gguggggcaaugggaucaggu

SEQ ID NO: 3187 - RNA, 21 nt, Homo sapiens
accugaucccauugccccacc

SEQ ID NO: 3188 - RNA, 23 nt, Homo sapiens
ggggaaagcgaguagggacauuu

SEQ ID NO: 3189 - RNA, 23 nt, Homo sapiens
aaaugucccuacucgcuuucccc

SEQ ID NO: 3190 - RNA, 22 nt, Homo sapiens
cagaaggggaguugggagcaga

SEQ ID NO: 3191 - RNA, 22 nt, Homo sapiens
ucugcucccaacuccccuucug

SEQ ID NO: 3192 - RNA, 21 nt, Homo sapiens
ccaggcucugcagugggaacu

SEQ ID NO: 3193 - RNA, 21 nt, Homo sapiens
aguucccacugcagagccugg

SEQ ID NO: 3194 - RNA, 21 nt, Homo sapiens
cucccacuuccagaucuuucu

SEQ ID NO: 3195 - RNA, 21 nt, Homo sapiens
agaaagaucuggaagugggag

SEQ ID NO: 3196 - RNA, 22 nt, Homo sapiens
aaagaucuggaagugggagaca

SEQ ID NO: 3197 - RNA, 22 nt, Homo sapiens
ugucucccacuuccagaucuuu

SEQ ID NO: 3198 - RNA, 22 nt, Homo sapiens
cugcccuagucuagcugaagcu

SEQ ID NO: 3199 - RNA, 22 nt, Homo sapiens
agcuucagcuagacuagggcag

SEQ ID NO: 3200 - RNA, 22 nt, Homo sapiens
uucagccaggcuagugcagucu

SEQ ID NO: 3201 - RNA, 22 nt, Homo sapiens
agacugcacuagccuggcugaa

SEQ ID NO: 3202 - RNA, 22 nt, Homo sapiens
uaggauuacaagugucggccac

SEQ ID NO: 3203 - RNA, 22 nt, Homo sapiens
guggccgacacuuguaauccua

SEQ ID NO: 3204 - RNA, 22 nt, Homo sapiens
agagcugagacuagaaagccca

SEQ ID NO: 3205 - RNA, 22 nt, Homo sapiens
ugggcuuucuagucucagcucu

SEQ ID NO: 3206 - RNA, 22 nt, Homo sapiens
ggcuuucuagucucagcucucc

SEQ ID NO: 3207 - RNA, 22 nt, Homo sapiens
ggagagcugagacuagaaagcc

SEQ ID NO: 3208 - RNA, 23 nt, Homo sapiens
cugauaagaacagaggcccagau

SEQ ID NO: 3209 - RNA, 23 nt, Homo sapiens
aucugggccucuguucuuaucag

SEQ ID NO: 3210 - RNA, 21 nt, Homo sapiens
ucccuaccccuccacucccca

SEQ ID NO: 3211 - RNA, 21 nt, Homo sapiens
uggggaguggagggguaggga

SEQ ID NO: 3212 - RNA, 23 nt, Homo sapiens
uuagggaguagaaggguggggag

SEQ ID NO: 3213 - RNA, 23 nt, Homo sapiens
cuccccacccuucuacucccuaa

SEQ ID NO: 3214 - RNA, 22 nt, Homo sapiens
uauaaaaugagggcaguaagac

SEQ ID NO: 3215 - RNA, 22 nt, Homo sapiens
gucuuacugcccucauuuuaua

SEQ ID NO: 3216 - RNA, 22 nt, Homo sapiens
ugugacuuuaagggaaauggcg

SEQ ID NO: 3217 - RNA, 22 nt, Homo sapiens
cgccauuucccuuaaagucaca

SEQ ID NO: 3218 - RNA, 22 nt, Homo sapiens
agguggaugcaaugugaccuca

SEQ ID NO: 3219 - RNA, 22 nt, Homo sapiens
ugaggucacauugcauccaccu

SEQ ID NO: 3220 - RNA, 23 nt, Homo sapiens
cgcagacaaugccuacuggccua

SEQ ID NO: 3221 - RNA, 23 nt, Homo sapiens
uaggccaguaggcauugucugcg

SEQ ID NO: 3222 - RNA, 17 nt, Homo sapiens
gaguucuacagucagac

SEQ ID NO: 3223 - RNA, 17 nt, Homo sapiens
gucugacuguagaacuc

SEQ ID NO: 3224 - RNA, 22 nt, Homo sapiens
uaggacugugcuuggcacauag

SEQ ID NO: 3225 - RNA, 22 nt, Homo sapiens
cuaugugccaagcacaguccua

SEQ ID NO: 3226 - RNA, 22 nt, Homo sapiens
cugggguucugagacagacagu

SEQ ID NO: 3227 - RNA, 22 nt, Homo sapiens
acugucugucucagaaccccag

SEQ ID NO: 3228 - RNA, 22 nt, Homo sapiens
aaaggaggaaauaggcaggcca

SEQ ID NO: 3229 - RNA, 22 nt, Homo sapiens
uggccugccuauuuccuccuuu

SEQ ID NO: 3230 - RNA, 22 nt, Homo sapiens
ugcccugccuguuuucuccuuu

SEQ ID NO: 3231 - RNA, 22 nt, Homo sapiens
aaaggagaaaacaggcagggca

SEQ ID NO: 3232 - RNA, 23 nt, Homo sapiens
uagugaguuagagaugcagagcc

SEQ ID NO: 3233 - RNA, 23 nt, Homo sapiens
ggcucugcaucucuaacucacua

SEQ ID NO: 3234 - RNA, 19 nt, Homo sapiens
acuggccugggacuaccgg

SEQ ID NO: 3235 - RNA, 19 nt, Homo sapiens
ccgguagucccaggccagu

SEQ ID NO: 3236 - RNA, 21 nt, Homo sapiens
ugcacggcacuggggacacgu

SEQ ID NO: 3237 - RNA, 21 nt, Homo sapiens
acguguccccagugccgugca

SEQ ID NO: 3238 - RNA, 23 nt, Homo sapiens
uguguacacacgugccaggcgcu

SEQ ID NO: 3239 - RNA, 23 nt, Homo sapiens
agcgccuggcacguguguacaca

SEQ ID NO: 3240 - RNA, 17 nt, Homo sapiens
ggggcgcggccggaucg

SEQ ID NO: 3241 - RNA, 17 nt, Homo sapiens
cgauccggccgcgcccc

SEQ ID NO: 3242 - RNA, 22 nt, Homo sapiens
agaaggggugaaauuuaaacgu

SEQ ID NO: 3243 - RNA, 22 nt, Homo sapiens
acguuuaaauuucaccccuucu

SEQ ID NO: 3244 - RNA, 19 nt, Homo sapiens
aucgggcccucggcgccgg

SEQ ID NO: 3245 - RNA, 19 nt, Homo sapiens
ccggcgccgagggcccgau

SEQ ID NO: 3246 - RNA, 17 nt, Homo sapiens
gcuucuguaguguaguc

SEQ ID NO: 3247 - RNA, 17 nt, Homo sapiens
gacuacacuacagaagc

SEQ ID NO: 3248 - RNA, 22 nt, Homo sapiens
gccucucucggagucgcucgga

SEQ ID NO: 3249 - RNA, 22 nt, Homo sapiens
uccgagcgacuccgagagaggc

SEQ ID NO: 3250 - RNA, 23 nt, Homo sapiens
aaagucucgcucucugccccuca

SEQ ID NO: 3251 - RNA, 23 nt, Homo sapiens
ugaggggcagagagcgagacuuu

SEQ ID NO: 3252 - RNA, 24 nt, Homo sapiens
ugaggggccucagaccgagcuuuu

SEQ ID NO: 3253 - RNA, 24 nt, Homo sapiens
aaaagcucggucugaggccccuca

SEQ ID NO: 3254 - RNA, 23 nt, Homo sapiens
agaagaaggcggucggucugcgg

SEQ ID NO: 3255 - RNA, 23 nt, Homo sapiens
ccgcagaccgaccgccuucuucu

SEQ ID NO: 3256 - RNA, 20 nt, Homo sapiens
uuggccauggggcugcgcgg

SEQ ID NO: 3257 - RNA, 20 nt, Homo sapiens
ccgcgcagccccauggccaa

SEQ ID NO: 3258 - RNA, 23 nt, Homo sapiens
ccugggcagcguguggcugaagg

SEQ ID NO: 3259 - RNA, 23 nt, Homo sapiens
ccuucagccacacgcugcccagg

SEQ ID NO: 3260 - RNA, 23 nt, Homo sapiens
agaggcuuugugcggauacgggg

SEQ ID NO: 3261 - RNA, 23 nt, Homo sapiens
ccccguauccgcacaaagccucu

SEQ ID NO: 3262 - RNA, 21 nt, Homo sapiens
cccuugggucugaugggguag

SEQ ID NO: 3263 - RNA, 21 nt, Homo sapiens
cuaccccaucagacccaaggg

SEQ ID NO: 3264 - RNA, 25 nt, Homo sapiens
ugccccaucugugcccuggguagga

SEQ ID NO: 3265 - RNA, 25 nt, Homo sapiens
uccuacccagggcacagauggggca

SEQ ID NO: 3266 - RNA, 23 nt, Homo sapiens
uguggaagguagacggccagaga

SEQ ID NO: 3267 - RNA, 23 nt, Homo sapiens
ucucuggccgucuaccuuccaca

SEQ ID NO: 3268 - RNA, 20 nt, Homo sapiens
ucuggccagcuacgucccca

SEQ ID NO: 3269 - RNA, 20 nt, Homo sapiens
uggggacguagcuggccaga

SEQ ID NO: 3270 - RNA, 23 nt, Homo sapiens
uggggacguagcuggccagacag

SEQ ID NO: 3271 - RNA, 23 nt, Homo sapiens
cugucuggccagcuacgucccca

SEQ ID NO: 3272 - RNA, 22 nt, Homo sapiens
cucucuggccgucuaccuucca

SEQ ID NO: 3273 - RNA, 22 nt, Homo sapiens
uggaagguagacggccagagag

SEQ ID NO: 3274 - RNA, 23 nt, Homo sapiens
ucugggagguuguagcaguggaa

SEQ ID NO: 3275 - RNA, 23 nt, Homo sapiens
uuccacugcuacaaccucccaga

SEQ ID NO: 3276 - RNA, 22 nt, Homo sapiens
uccugcguaggaucugaggagu

SEQ ID NO: 3277 - RNA, 22 nt, Homo sapiens
acuccucagauccuacgcagga

SEQ ID NO: 3278 - RNA, 22 nt, Homo sapiens
agcucugcugcucacuggcagu

SEQ ID NO: 3279 - RNA, 22 nt, Homo sapiens
acugccagugagcagcagagcu

SEQ ID NO: 3280 - RNA, 21 nt, Homo sapiens
ggccagccaccaggagggcug

SEQ ID NO: 3281 - RNA, 21 nt, Homo sapiens
cagcccuccugguggcuggcc

SEQ ID NO: 3282 - RNA, 17 nt, Homo sapiens
cgcgccgggcccggguu

SEQ ID NO: 3283 - RNA, 17 nt, Homo sapiens
aacccgggcccggcgcg

SEQ ID NO: 3284 - RNA, 23 nt, Homo sapiens
ggaggcgcaggcucggaaaggcg

SEQ ID NO: 3285 - RNA, 23 nt, Homo sapiens
cgccuuuccgagccugcgccucc

SEQ ID NO: 3286 - RNA, 22 nt, Homo sapiens
guggaguccuggggaauggaga

SEQ ID NO: 3287 - RNA, 22 nt, Homo sapiens
ucuccauuccccaggacuccac

SEQ ID NO: 3288 - RNA, 23 nt, Homo sapiens
agggacugccuuaggagaaaguu

SEQ ID NO: 3289 - RNA, 23 nt, Homo sapiens
aacuuucuccuaaggcagucccu

SEQ ID NO: 3290 - RNA, 17 nt, Homo sapiens
gggauaugaagaaaaau

SEQ ID NO: 3291 - RNA, 17 nt, Homo sapiens
auuuuucuucauauccc

SEQ ID NO: 3292 - RNA, 22 nt, Homo sapiens
uggaagggagaagagcuuuaau

SEQ ID NO: 3293 - RNA, 22 nt, Homo sapiens
auuaaagcucuucucccuucca

SEQ ID NO: 3294 - RNA, 22 nt, Homo sapiens
acuuuccucacucccgugaagu

SEQ ID NO: 3295 - RNA, 22 nt, Homo sapiens
acuucacgggagugaggaaagu

SEQ ID NO: 3296 - RNA, 21 nt, Homo sapiens
uucgcgggcgaaggcaaaguc

SEQ ID NO: 3297 - RNA, 21 nt, Homo sapiens
gacuuugccuucgcccgcgaa

SEQ ID NO: 3298 - RNA, 22 nt, Homo sapiens
caucuggcauccgucacacaga

SEQ ID NO: 3299 - RNA, 22 nt, Homo sapiens
ucugugugacggaugccagaug

SEQ ID NO: 3300 - RNA, 22 nt, Homo sapiens
ugagggacagaugccagaagca

SEQ ID NO: 3301 - RNA, 22 nt, Homo sapiens
ugcuucuggcaucugucccuca

SEQ ID NO: 3302 - RNA, 22 nt, Homo sapiens
aaacuaaucucuacacugcugc

SEQ ID NO: 3303 - RNA, 22 nt, Homo sapiens
gcagcaguguagagauuaguuu

SEQ ID NO: 3304 - RNA, 22 nt, Homo sapiens
gcaguaguguagagauugguuu

SEQ ID NO: 3305 - RNA, 22 nt, Homo sapiens
aaaccaaucucuacacuacugc

SEQ ID NO: 3306 - RNA, 21 nt, Homo sapiens
gcugcaccggagacuggguaa

SEQ ID NO: 3307 - RNA, 21 nt, Homo sapiens
uuacccagucuccggugcagc

SEQ ID NO: 3308 - RNA, 21 nt, Homo sapiens
uacccagucuccggugcagcc

SEQ ID NO: 3309 - RNA, 21 nt, Homo sapiens
ggcugcaccggagacugggua

SEQ ID NO: 3310 - RNA, 24 nt, Homo sapiens
uguggacagugagguagagggagu

SEQ ID NO: 3311 - RNA, 24 nt, Homo sapiens
acucccucuaccucacuguccaca

SEQ ID NO: 3312 - RNA, 22 nt, Homo sapiens
agcuuuugggaauucagguagu

SEQ ID NO: 3313 - RNA, 22 nt, Homo sapiens
acuaccugaauucccaaaagcu

SEQ ID NO: 3314 - RNA, 21 nt, Homo sapiens
accugaauuaccaaaagcuuu

SEQ ID NO: 3315 - RNA, 21 nt, Homo sapiens
aaagcuuuugguaauucaggu

SEQ ID NO: 3316 - RNA, 22 nt, Homo sapiens
auauaccuguucggucucuuua

SEQ ID NO: 3317 - RNA, 22 nt, Homo sapiens
uaaagagaccgaacagguauau

SEQ ID NO: 3318 - RNA, 22 nt, Homo sapiens
aggggaccaaagagauauauag

SEQ ID NO: 3319 - RNA, 22 nt, Homo sapiens
cuauauaucucuuugguccccu

SEQ ID NO: 3320 - RNA, 23 nt, Homo sapiens
uuuguauggauauguguguguau

SEQ ID NO: 3321 - RNA, 23 nt, Homo sapiens
auacacacacauauccauacaaa

SEQ ID NO: 3322 - RNA, 22 nt, Homo sapiens
uguguuagaauaggggcaauaa

SEQ ID NO: 3323 - RNA, 22 nt, Homo sapiens
uuauugccccuauucuaacaca

SEQ ID NO: 3324 - RNA, 22 nt, Homo sapiens
auugccucuguucuaacacaag

SEQ ID NO: 3325 - RNA, 22 nt, Homo sapiens
cuuguguuagaacagaggcaau

SEQ ID NO: 3326 - RNA, 22 nt, Homo sapiens
aagggcuuccucucugcaggac

SEQ ID NO: 3327 - RNA, 22 nt, Homo sapiens
guccugcagagaggaagcccuu

SEQ ID NO: 3328 - RNA, 21 nt, Homo sapiens
ccugcagagaggaagcccuuc

SEQ ID NO: 3329 - RNA, 21 nt, Homo sapiens
gaagggcuuccucucugcagg

SEQ ID NO: 3330 - RNA, 22 nt, Homo sapiens
aggauuucagaaauacuggugu

SEQ ID NO: 3331 - RNA, 22 nt, Homo sapiens
acaccaguauuucugaaauccu

SEQ ID NO: 3332 - RNA, 24 nt, Homo sapiens
agauguauggaaucuguauauauc

SEQ ID NO: 3333 - RNA, 24 nt, Homo sapiens
gauauauacagauuccauacaucu

SEQ ID NO: 3334 - RNA, 22 nt, Homo sapiens
cggggagagaacgcagugacgu

SEQ ID NO: 3335 - RNA, 22 nt, Homo sapiens
acgucacugcguucucuccccg

SEQ ID NO: 3336 - RNA, 19 nt, Homo sapiens
uggggcggagcuuccggag

SEQ ID NO: 3337 - RNA, 19 nt, Homo sapiens
cuccggaagcuccgcccca

SEQ ID NO: 3338 - RNA, 21 nt, Homo sapiens
ucacgcggagagauggcuuug

SEQ ID NO: 3339 - RNA, 21 nt, Homo sapiens
caaagccaucucuccgcguga

SEQ ID NO: 3340 - RNA, 22 nt, Homo sapiens
caggcgucugucuacguggcuu

SEQ ID NO: 3341 - RNA, 22 nt, Homo sapiens
aagccacguagacagacgccug

SEQ ID NO: 3342 - RNA, 22 nt, Homo sapiens
caccuugcgcuacucaggucug

SEQ ID NO: 3343 - RNA, 22 nt, Homo sapiens
cagaccugaguagcgcaaggug

SEQ ID NO: 3344 - RNA, 22 nt, Homo sapiens
aaucugagaaggcgcacaaggu

SEQ ID NO: 3345 - RNA, 22 nt, Homo sapiens
accuugugcgccuucucagauu

SEQ ID NO: 3346 - RNA, 22 nt, Homo sapiens
aaggccuuucugaaccuucaga

SEQ ID NO: 3347 - RNA, 22 nt, Homo sapiens
ucugaagguucagaaaggccuu

SEQ ID NO: 3348 - RNA, 22 nt, Homo sapiens
gugacaucacauauacggcagc

SEQ ID NO: 3349 - RNA, 22 nt, Homo sapiens
gcugccguauaugugaugucac

SEQ ID NO: 3350 - RNA, 24 nt, Homo sapiens
ucagaacaaaugccgguucccaga

SEQ ID NO: 3351 - RNA, 24 nt, Homo sapiens
ucugggaaccggcauuuguucuga

SEQ ID NO: 3352 - RNA, 22 nt, Homo sapiens
ugagaaccacgucugcucugag

SEQ ID NO: 3353 - RNA, 22 nt, Homo sapiens
cucagagcagacgugguucuca

SEQ ID NO: 3354 - RNA, 17 nt, Homo sapiens
ucauauugcuucuuucu

SEQ ID NO: 3355 - RNA, 17 nt, Homo sapiens
agaaagaagcaauauga

SEQ ID NO: 3356 - RNA, 22 nt, Homo sapiens
ugugacagauugauaacugaaa

SEQ ID NO: 3357 - RNA, 22 nt, Homo sapiens
uuucaguuaucaaucugucaca

SEQ ID NO: 3358 - RNA, 23 nt, Homo sapiens
uggaguccaggaaucugcauuuu

SEQ ID NO: 3359 - RNA, 23 nt, Homo sapiens
aaaaugcagauuccuggacucca

SEQ ID NO: 3360 - RNA, 22 nt, Homo sapiens
aagcccuuaccccaaaaaguau

SEQ ID NO: 3361 - RNA, 22 nt, Homo sapiens
auacuuuuugggguaagggcuu

SEQ ID NO: 3362 - RNA, 22 nt, Homo sapiens
aagcccuuaccccaaaaagcau

SEQ ID NO: 3363 - RNA, 22 nt, Homo sapiens
augcuuuuugggguaagggcuu

SEQ ID NO: 3364 - RNA, 22 nt, Homo sapiens
uggaauguaaggaagugugugg

SEQ ID NO: 3365 - RNA, 22 nt, Homo sapiens
ccacacacuuccuuacauucca

SEQ ID NO: 3366 - RNA, 22 nt, Homo sapiens
cuuaucagauuguauuguaauu

SEQ ID NO: 3367 - RNA, 22 nt, Homo sapiens
aauuacaauacaaucugauaag

SEQ ID NO: 3368 - RNA, 22 nt, Homo sapiens
uuauaauacaaccugauaagug

SEQ ID NO: 3369 - RNA, 22 nt, Homo sapiens
cacuuaucagguuguauuauaa

SEQ ID NO: 3370 - RNA, 22 nt, Homo sapiens
cuuagcagguuguauuaucauu

SEQ ID NO: 3371 - RNA, 22 nt, Homo sapiens
aaugauaauacaaccugcuaag

SEQ ID NO: 3372 - RNA, 22 nt, Homo sapiens
auauaauacaaccugcuaagug

SEQ ID NO: 3373 - RNA, 22 nt, Homo sapiens
cacuuagcagguuguauuauau

SEQ ID NO: 3374 - RNA, 22 nt, Homo sapiens
cacuuagcagguuguauuauau

SEQ ID NO: 3375 - RNA, 22 nt, Homo sapiens
auauaauacaaccugcuaagug

SEQ ID NO: 3376 - RNA, 22 nt, Homo sapiens
auaauacaaccugcuaagugcu

SEQ ID NO: 3377 - RNA, 22 nt, Homo sapiens
agcacuuagcagguuguauuau

SEQ ID NO: 3378 - RNA, 22 nt, Homo sapiens
uuugguccccuucaaccagcug

SEQ ID NO: 3379 - RNA, 22 nt, Homo sapiens
cagcugguugaaggggaccaaa

SEQ ID NO: 3380 - RNA, 22 nt, Homo sapiens
uuugguccccuucaaccagcua

SEQ ID NO: 3381 - RNA, 22 nt, Homo sapiens
uagcugguugaaggggaccaaa

SEQ ID NO: 3382 - RNA, 22 nt, Homo sapiens
uguaaacauccuugacuggaag

SEQ ID NO: 3383 - RNA, 22 nt, Homo sapiens
cuuccagucaaggauguuuaca

SEQ ID NO: 3384 - RNA, 22 nt, Homo sapiens
ugucaguuugucaaauacccca

SEQ ID NO: 3385 - RNA, 22 nt, Homo sapiens
ugggguauuugacaaacugaca

SEQ ID NO: 3386 - RNA, 22 nt, Homo sapiens
cguguauuugacaagcugaguu

SEQ ID NO: 3387 - RNA, 22 nt, Homo sapiens
aacucagcuugucaaauacacg

SEQ ID NO: 3388 - RNA, 21 nt, Homo sapiens
uucacaguggcuaaguuccgc

SEQ ID NO: 3389 - RNA, 21 nt, Homo sapiens
gcggaacuuagccacugugaa

SEQ ID NO: 3390 - RNA, 22 nt, Homo sapiens
agggcuuagcugcuugugagca

SEQ ID NO: 3391 - RNA, 22 nt, Homo sapiens
ugcucacaagcagcuaagcccu

SEQ ID NO: 3392 - RNA, 21 nt, Homo sapiens
aucacauugccagggauuacc

SEQ ID NO: 3393 - RNA, 21 nt, Homo sapiens
gguaaucccuggcaaugugau

SEQ ID NO: 3394 - RNA, 22 nt, Homo sapiens
uggguuccuggcaugcugauuu

SEQ ID NO: 3395 - RNA, 22 nt, Homo sapiens
aaaucagcaugccaggaaccca

SEQ ID NO: 3396 - RNA, 22 nt, Homo sapiens
cuuucagucggauguuuacagc

SEQ ID NO: 3397 - RNA, 22 nt, Homo sapiens
gcuguaaacauccgacugaaag

SEQ ID NO: 3398 - RNA, 22 nt, Homo sapiens
ugccuacugagcugauaucagu

SEQ ID NO: 3399 - RNA, 22 nt, Homo sapiens
acugauaucagcucaguaggca

SEQ ID NO: 3400 - RNA, 22 nt, Homo sapiens
ugccuacugagcugaaacacag

SEQ ID NO: 3401 - RNA, 22 nt, Homo sapiens
cuguguuucagcucaguaggca

SEQ ID NO: 3402 - RNA, 22 nt, Homo sapiens
uggcucaguucagcaggaacag

SEQ ID NO: 3403 - RNA, 22 nt, Homo sapiens
cuguuccugcugaacugagcca

SEQ ID NO: 3404 - RNA, 21 nt, Homo sapiens
uucacaguggcuaaguucugc

SEQ ID NO: 3405 - RNA, 21 nt, Homo sapiens
gcagaacuuagccacugugaa

SEQ ID NO: 3406 - RNA, 22 nt, Homo sapiens
agagcuuagcugauuggugaac

SEQ ID NO: 3407 - RNA, 22 nt, Homo sapiens
guucaccaaucagcuaagcucu

SEQ ID NO: 3408 - RNA, 23 nt, Homo sapiens
uguaguguuuccuacuuuaugga

SEQ ID NO: 3409 - RNA, 23 nt, Homo sapiens
uccauaaaguaggaaacacuaca

SEQ ID NO: 3410 - RNA, 21 nt, Homo sapiens
cauaaaguagaaagcacuacu

SEQ ID NO: 3411 - RNA, 21 nt, Homo sapiens
aguagugcuuucuacuuuaug

SEQ ID NO: 3412 - RNA, 22 nt, Homo sapiens
ugaaggucuacugugugccagg

SEQ ID NO: 3413 - RNA, 22 nt, Homo sapiens
ccuggcacacaguagaccuuca

SEQ ID NO: 3414 - RNA, 22 nt, Homo sapiens
uuguacaugguaggcuuucauu

SEQ ID NO: 3415 - RNA, 22 nt, Homo sapiens
aaugaaagccuaccauguacaa

SEQ ID NO: 3416 - RNA, 21 nt, Homo sapiens
cuggauggcuccuccaugucu

SEQ ID NO: 3417 - RNA, 21 nt, Homo sapiens
agacauggaggagccauccag

SEQ ID NO: 3418 - RNA, 23 nt, Homo sapiens
ucuuggaguaggucauugggugg

SEQ ID NO: 3419 - RNA, 23 nt, Homo sapiens
ccacccaaugaccuacuccaaga

SEQ ID NO: 3420 - RNA, 22 nt, Homo sapiens
cucaucugcaaagaaguaagug

SEQ ID NO: 3421 - RNA, 22 nt, Homo sapiens
cacuuacuucuuugcagaugag

SEQ ID NO: 3422 - RNA, 22 nt, Homo sapiens
aacuguuugcagaggaaacuga

SEQ ID NO: 3423 - RNA, 22 nt, Homo sapiens
ucaguuuccucugcaaacaguu

SEQ ID NO: 3424 - RNA, 22 nt, Homo sapiens
cuugguucagggagggucccca

SEQ ID NO: 3425 - RNA, 22 nt, Homo sapiens
uggggacccucccugaaccaag

SEQ ID NO: 3426 - RNA, 22 nt, Homo sapiens
aggaccuucccugaaccaagga

SEQ ID NO: 3427 - RNA, 22 nt, Homo sapiens
uccuugguucagggaagguccu

SEQ ID NO: 3428 - RNA, 21 nt, Homo sapiens
accuccugugugcauggauua

SEQ ID NO: 3429 - RNA, 21 nt, Homo sapiens
uaauccaugcacacaggaggu

SEQ ID NO: 3430 - RNA, 22 nt, Homo sapiens
uacccauugcauaucggaguug

SEQ ID NO: 3431 - RNA, 22 nt, Homo sapiens
caacuccgauaugcaaugggua

SEQ ID NO: 3432 - RNA, 18 nt, Homo sapiens
aaagcuggguugagaagg

SEQ ID NO: 3433 - RNA, 18 nt, Homo sapiens
ccuucucaacccagcuuu

SEQ ID NO: 3434 - RNA, 20 nt, Homo sapiens
gguauccguuuggggauggu

SEQ ID NO: 3435 - RNA, 20 nt, Homo sapiens
accauccccaaacggauacc

SEQ ID NO: 3436 - RNA, 22 nt, Homo sapiens
gaaggcagcagugcuccccugu

SEQ ID NO: 3437 - RNA, 22 nt, Homo sapiens
acaggggagcacugcugccuuc

SEQ ID NO: 3438 - RNA, 22 nt, Homo sapiens
ucagugcaucacagaacuuugu

SEQ ID NO: 3439 - RNA, 22 nt, Homo sapiens
acaaaguucugugaugcacuga

SEQ ID NO: 3440 - RNA, 22 nt, Homo sapiens
aaguucuguuauacacucaggc

SEQ ID NO: 3441 - RNA, 22 nt, Homo sapiens
gccugaguguauaacagaacuu

SEQ ID NO: 3442 - RNA, 22 nt, Homo sapiens
cuggcccucucugcccuuccgu

SEQ ID NO: 3443 - RNA, 22 nt, Homo sapiens
acggaagggcagagagggccag

SEQ ID NO: 3444 - RNA, 21 nt, Homo sapiens
cuagacugaagcuccuugagg

SEQ ID NO: 3445 - RNA, 21 nt, Homo sapiens
ccucaaggagcuucagucuag

SEQ ID NO: 3446 - RNA, 21 nt, Homo sapiens
ucgaggagcucacagucuagu

SEQ ID NO: 3447 - RNA, 21 nt, Homo sapiens
acuagacugugagcuccucga

SEQ ID NO: 3448 - RNA, 21 nt, Homo sapiens
cacauuacacggucgaccucu

SEQ ID NO: 3449 - RNA, 21 nt, Homo sapiens
agaggucgaccguguaaugug

SEQ ID NO: 3450 - RNA, 22 nt, Homo sapiens
aggugguccguggcgcguucgc

SEQ ID NO: 3451 - RNA, 22 nt, Homo sapiens
gcgaacgcgccacggaccaccu

SEQ ID NO: 3452 - RNA, 23 nt, Homo sapiens
cgcauccccuagggcauuggugu

SEQ ID NO: 3453 - RNA, 23 nt, Homo sapiens
acaccaaugcccuaggggaugcg

SEQ ID NO: 3454 - RNA, 20 nt, Homo sapiens
ccucugggcccuuccuccag

SEQ ID NO: 3455 - RNA, 20 nt, Homo sapiens
cuggaggaagggcccagagg

SEQ ID NO: 3456 - RNA, 23 nt, Homo sapiens
ccuaguagguguccaguaagugu

SEQ ID NO: 3457 - RNA, 23 nt, Homo sapiens
acacuuacuggacaccuacuagg

SEQ ID NO: 3458 - RNA, 21 nt, Homo sapiens
acggugcuggauguggccuuu

SEQ ID NO: 3459 - RNA, 21 nt, Homo sapiens
aaaggccacauccagcaccgu

SEQ ID NO: 3460 - RNA, 23 nt, Homo sapiens
ucagcaccaggauauuguuggag

SEQ ID NO: 3461 - RNA, 23 nt, Homo sapiens
cuccaacaauauccuggugcuga

SEQ ID NO: 3462 - RNA, 23 nt, Homo sapiens
ucaacaaaaucacugaugcugga

SEQ ID NO: 3463 - RNA, 23 nt, Homo sapiens
uccagcaucagugauuuuguuga

SEQ ID NO: 3464 - RNA, 22 nt, Homo sapiens
aacaauauccuggugcugagug

SEQ ID NO: 3465 - RNA, 22 nt, Homo sapiens
cacucagcaccaggauauuguu

SEQ ID NO: 3466 - RNA, 23 nt, Homo sapiens
ggcagguucucacccucucuagg

SEQ ID NO: 3467 - RNA, 23 nt, Homo sapiens
ccuagagagggugagaaccugcc

SEQ ID NO: 3468 - RNA, 23 nt, Homo sapiens
gacacgggcgacagcugcggccc

SEQ ID NO: 3469 - RNA, 23 nt, Homo sapiens
gggccgcagcugucgcccguguc

SEQ ID NO: 3470 - RNA, 21 nt, Homo sapiens
auguaugugugcaugugcaug

SEQ ID NO: 3471 - RNA, 21 nt, Homo sapiens
caugcacaugcacacauacau

SEQ ID NO: 3472 - RNA, 22 nt, Homo sapiens
uauacaagggcagacucucucu

SEQ ID NO: 3473 - RNA, 22 nt, Homo sapiens
agagagagucugcccuuguaua

SEQ ID NO: 3474 - RNA, 20 nt, Homo sapiens
ggcggcggcggaggcggggg

SEQ ID NO: 3475 - RNA, 20 nt, Homo sapiens
cccccgccuccgccgccgcc

SEQ ID NO: 3476 - RNA, 22 nt, Homo sapiens
gcaggugcucacuuguccuccu

SEQ ID NO: 3477 - RNA, 22 nt, Homo sapiens
aggaggacaagugagcaccugc

SEQ ID NO: 3478 - RNA, 19 nt, Homo sapiens
ggggccuggcggugggcgg

SEQ ID NO: 3479 - RNA, 19 nt, Homo sapiens
ccgcccaccgccaggcccc

SEQ ID NO: 3480 - RNA, 22 nt, Homo sapiens
gcccaaaggugaauuuuuuggg

SEQ ID NO: 3481 - RNA, 22 nt, Homo sapiens
cccaaaaaauucaccuuugggc

SEQ ID NO: 3482 - RNA, 22 nt, Homo sapiens
caaagaauucuccuuuugggcu

SEQ ID NO: 3483 - RNA, 22 nt, Homo sapiens
agcccaaaaggagaauucuuug

SEQ ID NO: 3484 - RNA, 22 nt, Homo sapiens
cugcaauguaagcacuucuuac

SEQ ID NO: 3485 - RNA, 22 nt, Homo sapiens
guaagaagugcuuacauugcag

SEQ ID NO: 3486 - RNA, 23 nt, Homo sapiens
aaaagugcuuacagugcagguag

SEQ ID NO: 3487 - RNA, 23 nt, Homo sapiens
cuaccugcacuguaagcacuuuu

SEQ ID NO: 3488 - RNA, 22 nt, Homo sapiens
acuguaguaugggcacuuccag

SEQ ID NO: 3489 - RNA, 22 nt, Homo sapiens
cuggaagugcccauacuacagu

SEQ ID NO: 3490 - RNA, 23 nt, Homo sapiens
caaagugcucauagugcagguag

SEQ ID NO: 3491 - RNA, 23 nt, Homo sapiens
cuaccugcacuaugagcacuuug

SEQ ID NO: 3492 - RNA, 23 nt, Homo sapiens
gggguauuguuuccgcugccagg

SEQ ID NO: 3493 - RNA, 23 nt, Homo sapiens
ccuggcagcggaaacaauacccc

SEQ ID NO: 3494 - RNA, 23 nt, Homo sapiens
uagcagcgggaacaguucugcag

SEQ ID NO: 3495 - RNA, 23 nt, Homo sapiens
cugcagaacuguucccgcugcua

SEQ ID NO: 3496 - RNA, 21 nt, Homo sapiens
cgagccucaagcaagggacuu

SEQ ID NO: 3497 - RNA, 21 nt, Homo sapiens
aagucccuugcuugaggcucg

SEQ ID NO: 3498 - RNA, 22 nt, Homo sapiens
uagucccuuccuugaagcgguc

SEQ ID NO: 3499 - RNA, 22 nt, Homo sapiens
gaccgcuucaaggaagggacua

SEQ ID NO: 3500 - RNA, 21 nt, Homo sapiens
acuggacuuggagucagaagg

SEQ ID NO: 3501 - RNA, 21 nt, Homo sapiens
ccuucugacuccaaguccagu

SEQ ID NO: 3502 - RNA, 22 nt, Homo sapiens
cuccugacuccagguccugugu

SEQ ID NO: 3503 - RNA, 22 nt, Homo sapiens
acacaggaccuggagucaggag

SEQ ID NO: 3504 - RNA, 22 nt, Homo sapiens
uuuguucguucggcucgcguga

SEQ ID NO: 3505 - RNA, 22 nt, Homo sapiens
ucacgcgagccgaacgaacaaa

SEQ ID NO: 3506 - RNA, 22 nt, Homo sapiens
acggauguuugagcaugugcua

SEQ ID NO: 3507 - RNA, 22 nt, Homo sapiens
uagcacaugcucaaacauccgu

SEQ ID NO: 3508 - RNA, 23 nt, Homo sapiens
ucaaaugcucagacuccuguggu

SEQ ID NO: 3509 - RNA, 23 nt, Homo sapiens
accacaggagucugagcauuuga

SEQ ID NO: 3510 - RNA, 22 nt, Homo sapiens
cggcaacaagaaacugccugag

SEQ ID NO: 3511 - RNA, 22 nt, Homo sapiens
cucaggcaguuucuuguugccg

SEQ ID NO: 3512 - RNA, 22 nt, Homo sapiens
uagguaguuucauguuguuggg

SEQ ID NO: 3513 - RNA, 22 nt, Homo sapiens
cccaacaacaugaaacuaccua

SEQ ID NO: 3514 - RNA, 22 nt, Homo sapiens
caauguuuccacagugcaucac

SEQ ID NO: 3515 - RNA, 22 nt, Homo sapiens
gugaugcacuguggaaacauug

SEQ ID NO: 3516 - RNA, 21 nt, Homo sapiens
gugcauuguaguugcauugca

SEQ ID NO: 3517 - RNA, 21 nt, Homo sapiens
ugcaaugcaacuacaaugcac

SEQ ID NO: 3518 - RNA, 18 nt, Homo sapiens
aucccaccucugccacca

SEQ ID NO: 3519 - RNA, 18 nt, Homo sapiens
ugguggcagaggugggau

SEQ ID NO: 3520 - RNA, 19 nt, Homo sapiens
aucccaccacugccaccau

SEQ ID NO: 3521 - RNA, 19 nt, Homo sapiens
augguggcaguggugggau

SEQ ID NO: 3522 - RNA, 22 nt, Homo sapiens
accuuccucuccaugggucuuu

SEQ ID NO: 3523 - RNA, 22 nt, Homo sapiens
aaagacccauggagaggaaggu

SEQ ID NO: 3524 - RNA, 22 nt, Homo sapiens
aaagacccauugaggagaaggu

SEQ ID NO: 3525 - RNA, 22 nt, Homo sapiens
accuucuccucaaugggucuuu

SEQ ID NO: 3526 - RNA, 21 nt, Homo sapiens
aauguagagauugaucaaaau

SEQ ID NO: 3527 - RNA, 21 nt, Homo sapiens
auuuugaucaaucucuacauu

SEQ ID NO: 3528 - RNA, 23 nt, Homo sapiens
acggaauauguauacggaauaua

SEQ ID NO: 3529 - RNA, 23 nt, Homo sapiens
uauauuccguauacauauuccgu

SEQ ID NO: 3530 - RNA, 24 nt, Homo sapiens
agagcucacagcuguccuucucua

SEQ ID NO: 3531 - RNA, 24 nt, Homo sapiens
uagagaaggacagcugugagcucu

SEQ ID NO: 3532 - RNA, 22 nt, Homo sapiens
aucaaauaaggacuagucugca

SEQ ID NO: 3533 - RNA, 22 nt, Homo sapiens
ugcagacuaguccuuauuugau

SEQ ID NO: 3534 - RNA, 23 nt, Homo sapiens
augagacucauguaaaacaucuu

SEQ ID NO: 3535 - RNA, 23 nt, Homo sapiens
aagauguuuuacaugagucucau

SEQ ID NO: 3536 - RNA, 21 nt, Homo sapiens
auggaauguauauacggaaua

SEQ ID NO: 3537 - RNA, 21 nt, Homo sapiens
uauuccguauauacauuccau

SEQ ID NO: 3538 - RNA, 22 nt, Homo sapiens
auuguagaaccuaagauuggcc

SEQ ID NO: 3539 - RNA, 22 nt, Homo sapiens
ggccaaucuuagguucuacaau

SEQ ID NO: 3540 - RNA, 22 nt, Homo sapiens
caucucuaaggaacucccccaa

SEQ ID NO: 3541 - RNA, 22 nt, Homo sapiens
uugggggaguuccuuagagaug

SEQ ID NO: 3542 - RNA, 23 nt, Homo sapiens
uauggggcuucuguagagauuuc

SEQ ID NO: 3543 - RNA, 23 nt, Homo sapiens
gaaaucucuacagaagccccaua

SEQ ID NO: 3544 - RNA, 20 nt, Homo sapiens
ccguguuucccccacgcuuu

SEQ ID NO: 3545 - RNA, 20 nt, Homo sapiens
aaagcgugggggaaacacgg

SEQ ID NO: 3546 - RNA, 15 nt, Homo sapiens
aggagauccuggguu

SEQ ID NO: 3547 - RNA, 15 nt, Homo sapiens
aacccaggaucuccu

SEQ ID NO: 3548 - RNA, 22 nt, Homo sapiens
cucgugggcucuggccacggcc

SEQ ID NO: 3549 - RNA, 22 nt, Homo sapiens
ggccguggccagagcccacgag

SEQ ID NO: 3550 - RNA, 22 nt, Homo sapiens
caguggccagagcccugcagug

SEQ ID NO: 3551 - RNA, 22 nt, Homo sapiens
cacugcagggcucuggccacug

SEQ ID NO: 3552 - RNA, 22 nt, Homo sapiens
cugcagaguuuguacggaccgg

SEQ ID NO: 3553 - RNA, 22 nt, Homo sapiens
ccgguccguacaaacucugcag

SEQ ID NO: 3554 - RNA, 20 nt, Homo sapiens
uccguacaaacucugcugug

SEQ ID NO: 3555 - RNA, 20 nt, Homo sapiens
cacagcagaguuuguacgga

SEQ ID NO: 3556 - RNA, 22 nt, Homo sapiens
cuuccccccaguaaucuucauc

SEQ ID NO: 3557 - RNA, 22 nt, Homo sapiens
gaugaagauuacuggggggaag

SEQ ID NO: 3558 - RNA, 23 nt, Homo sapiens
ugaggauauggcagggaagggga

SEQ ID NO: 3559 - RNA, 23 nt, Homo sapiens
uccccuucccugccauauccuca

SEQ ID NO: 3560 - RNA, 23 nt, Homo sapiens
uuuugcaugacccugggaguagg

SEQ ID NO: 3561 - RNA, 23 nt, Homo sapiens
ccuacucccagggucaugcaaaa

SEQ ID NO: 3562 - RNA, 22 nt, Homo sapiens
gacucacucacaggauugugca

SEQ ID NO: 3563 - RNA, 22 nt, Homo sapiens
ugcacaauccugugagugaguc

SEQ ID NO: 3564 - RNA, 22 nt, Homo sapiens
acacagugcuucauccacuacu

SEQ ID NO: 3565 - RNA, 22 nt, Homo sapiens
aguaguggaugaagcacugugu

SEQ ID NO: 3566 - RNA, 22 nt, Homo sapiens
uaguggaugaugcacucugugc

SEQ ID NO: 3567 - RNA, 22 nt, Homo sapiens
gcacagagugcaucauccacua

SEQ ID NO: 3568 - RNA, 21 nt, Homo sapiens
ugaugauacagguggagguag

SEQ ID NO: 3569 - RNA, 21 nt, Homo sapiens
cuaccuccaccuguaucauca

SEQ ID NO: 3570 - RNA, 22 nt, Homo sapiens
cuacuucuaccuguguuaucau

SEQ ID NO: 3571 - RNA, 22 nt, Homo sapiens
augauaacacagguagaaguag

SEQ ID NO: 3572 - RNA, 22 nt, Homo sapiens
ugcgacauuggaaguaguauca

SEQ ID NO: 3573 - RNA, 22 nt, Homo sapiens
ugauacuacuuccaaugucgca

SEQ ID NO: 3574 - RNA, 21 nt, Homo sapiens
uuagaccuaguacacguccuu

SEQ ID NO: 3575 - RNA, 21 nt, Homo sapiens
aaggacguguacuaggucuaa

SEQ ID NO: 3576 - RNA, 22 nt, Homo sapiens
uuuccuacccuaccugaagacu

SEQ ID NO: 3577 - RNA, 22 nt, Homo sapiens
agucuucagguaggguaggaaa

SEQ ID NO: 3578 - RNA, 22 nt, Homo sapiens
aucuguaagagaaaguaaauga

SEQ ID NO: 3579 - RNA, 22 nt, Homo sapiens
ucauuuacuuucucuuacagau

SEQ ID NO: 3580 - RNA, 24 nt, Homo sapiens
cccggacaggcguucgugcgacgu

SEQ ID NO: 3581 - RNA, 24 nt, Homo sapiens
acgucgcacgaacgccuguccggg

SEQ ID NO: 3582 - RNA, 23 nt, Homo sapiens
accuggacccagcguagacaaag

SEQ ID NO: 3583 - RNA, 23 nt, Homo sapiens
cuuugucuacgcuggguccaggu

SEQ ID NO: 3584 - RNA, 22 nt, Homo sapiens
accaagucugcgucauccucuc

SEQ ID NO: 3585 - RNA, 22 nt, Homo sapiens
gagaggaugacgcagacuuggu

SEQ ID NO: 3586 - RNA, 23 nt, Homo sapiens
aguggaugauggagacucgguac

SEQ ID NO: 3587 - RNA, 23 nt, Homo sapiens
guaccgagucuccaucauccacu

SEQ ID NO: 3588 - RNA, 24 nt, Homo sapiens
guuccacacugacacugcagaagu

SEQ ID NO: 3589 - RNA, 24 nt, Homo sapiens
acuucugcagugucaguguggaac

SEQ ID NO: 3590 - RNA, 24 nt, Homo sapiens
ccugcuggucaggaguggauacug

SEQ ID NO: 3591 - RNA, 24 nt, Homo sapiens
caguauccacuccugaccagcagg

SEQ ID NO: 3592 - RNA, 23 nt, Homo sapiens
gagggucuugggagggaugugac

SEQ ID NO: 3593 - RNA, 23 nt, Homo sapiens
gucacaucccucccaagacccuc

SEQ ID NO: 3594 - RNA, 22 nt, Homo sapiens
auauacagggggagacucuuau

SEQ ID NO: 3595 - RNA, 22 nt, Homo sapiens
auaagagucucccccuguauau

SEQ ID NO: 3596 - RNA, 22 nt, Homo sapiens
auauacagggggagacucucau

SEQ ID NO: 3597 - RNA, 22 nt, Homo sapiens
augagagucucccccuguauau

SEQ ID NO: 3598 - RNA, 21 nt, Homo sapiens
agaggauacccuuuguauguu

SEQ ID NO: 3599 - RNA, 21 nt, Homo sapiens
aacauacaaaggguauccucu

SEQ ID NO: 3600 - RNA, 22 nt, Homo sapiens
ucuacaaaggaaagcgcuuucu

SEQ ID NO: 3601 - RNA, 22 nt, Homo sapiens
agaaagcgcuuuccuuuguaga

SEQ ID NO: 3602 - RNA, 22 nt, Homo sapiens
ucaaaacugaggggcauuuucu

SEQ ID NO: 3603 - RNA, 22 nt, Homo sapiens
agaaaaugccccucaguuuuga

SEQ ID NO: 3604 - RNA, 24 nt, Homo sapiens
uucuccaaaagaaagcacuuucug

SEQ ID NO: 3605 - RNA, 24 nt, Homo sapiens
cagaaagugcuuucuuuuggagaa

SEQ ID NO: 3606 - RNA, 23 nt, Homo sapiens
uucucgaggaaagaagcacuuuc

SEQ ID NO: 3607 - RNA, 23 nt, Homo sapiens
gaaagugcuucuuuccucgagaa

SEQ ID NO: 3608 - RNA, 22 nt, Homo sapiens
ccucuagauggaagcacugucu

SEQ ID NO: 3609 - RNA, 22 nt, Homo sapiens
agacagugcuuccaucuagagg

SEQ ID NO: 3610 - RNA, 22 nt, Homo sapiens
aucgugcaucccuuuagagugu

SEQ ID NO: 3611 - RNA, 22 nt, Homo sapiens
acacucuaaagggaugcacgau

SEQ ID NO: 3612 - RNA, 22 nt, Homo sapiens
aucgugcaucccuuuagagugu

SEQ ID NO: 3613 - RNA, 22 nt, Homo sapiens
acacucuaaagggaugcacgau

SEQ ID NO: 3614 - RNA, 22 nt, Homo sapiens
aucgugcauccuuuuagagugu

SEQ ID NO: 3615 - RNA, 22 nt, Homo sapiens
acacucuaaaaggaugcacgau

SEQ ID NO: 3616 - RNA, 22 nt, Homo sapiens
caaagcgcuccccuuuagaggu

SEQ ID NO: 3617 - RNA, 22 nt, Homo sapiens
accucuaaaggggagcgcuuug

SEQ ID NO: 3618 - RNA, 23 nt, Homo sapiens
caaagcgcuucucuuuagagugu

SEQ ID NO: 3619 - RNA, 23 nt, Homo sapiens
acacucuaaagagaagcgcuuug

SEQ ID NO: 3620 - RNA, 23 nt, Homo sapiens
ucucuggagggaagcacuuucug

SEQ ID NO: 3621 - RNA, 23 nt, Homo sapiens
cagaaagugcuucccuccagaga

SEQ ID NO: 3622 - RNA, 21 nt, Homo sapiens
gaaagcgcuucucuuuagagg

SEQ ID NO: 3623 - RNA, 21 nt, Homo sapiens
ccucuaaagagaagcgcuuuc

SEQ ID NO: 3624 - RNA, 22 nt, Homo sapiens
cucuagagggaagcacuuucuc

SEQ ID NO: 3625 - RNA, 22 nt, Homo sapiens
gagaaagugcuucccucuagag

SEQ ID NO: 3626 - RNA, 22 nt, Homo sapiens
aaagugcauccuuuuagagugu

SEQ ID NO: 3627 - RNA, 22 nt, Homo sapiens
acacucuaaaaggaugcacuuu

SEQ ID NO: 3628 - RNA, 22 nt, Homo sapiens
cucuagagggaagcgcuuucug

SEQ ID NO: 3629 - RNA, 22 nt, Homo sapiens
cagaaagcgcuucccucuagag

SEQ ID NO: 3630 - RNA, 22 nt, Homo sapiens
caaagugccucccuuuagagug

SEQ ID NO: 3631 - RNA, 22 nt, Homo sapiens
cacucuaaagggaggcacuuug

SEQ ID NO: 3632 - RNA, 22 nt, Homo sapiens
aagugccuccuuuuagaguguu

SEQ ID NO: 3633 - RNA, 22 nt, Homo sapiens
aacacucuaaaaggaggcacuu

SEQ ID NO: 3634 - RNA, 22 nt, Homo sapiens
uucuccaaaagggagcacuuuc

SEQ ID NO: 3635 - RNA, 22 nt, Homo sapiens
gaaagugcucccuuuuggagaa

SEQ ID NO: 3636 - RNA, 22 nt, Homo sapiens
aaagugcuucccuuuggacugu

SEQ ID NO: 3637 - RNA, 22 nt, Homo sapiens
acaguccaaagggaagcacuuu

SEQ ID NO: 3638 - RNA, 21 nt, Homo sapiens
cuccagagggaaguacuuucu

SEQ ID NO: 3639 - RNA, 21 nt, Homo sapiens
agaaaguacuucccucuggag

SEQ ID NO: 3640 - RNA, 22 nt, Homo sapiens
acaaagugcuucccuuuagagu

SEQ ID NO: 3641 - RNA, 22 nt, Homo sapiens
acucuaaagggaagcacuuugu

SEQ ID NO: 3642 - RNA, 22 nt, Homo sapiens
cuacaaagggaagcacuuucuc

SEQ ID NO: 3643 - RNA, 22 nt, Homo sapiens
gagaaagugcuucccuuuguag

SEQ ID NO: 3644 - RNA, 22 nt, Homo sapiens
gaaggcgcuucccuuuagagcg

SEQ ID NO: 3645 - RNA, 22 nt, Homo sapiens
cgcucuaaagggaagcgccuuc

SEQ ID NO: 3646 - RNA, 21 nt, Homo sapiens
cuccagagggaugcacuuucu

SEQ ID NO: 3647 - RNA, 21 nt, Homo sapiens
agaaagugcaucccucuggag

SEQ ID NO: 3648 - RNA, 22 nt, Homo sapiens
cucuagagggaagcacuuucug

SEQ ID NO: 3649 - RNA, 22 nt, Homo sapiens
cagaaagugcuucccucuagag

SEQ ID NO: 3650 - RNA, 22 nt, Homo sapiens
gaaagugcuuccuuuuagaggc

SEQ ID NO: 3651 - RNA, 22 nt, Homo sapiens
gccucuaaaaggaagcacuuuc

SEQ ID NO: 3652 - RNA, 23 nt, Homo sapiens
cucuugagggaagcacuuucugu

SEQ ID NO: 3653 - RNA, 23 nt, Homo sapiens
acagaaagugcuucccucaagag

SEQ ID NO: 3654 - RNA, 22 nt, Homo sapiens
acuggacuuagggucagaaggc

SEQ ID NO: 3655 - RNA, 22 nt, Homo sapiens
gccuucugacccuaaguccagu

SEQ ID NO: 3656 - RNA, 22 nt, Homo sapiens
aaacaaacauggugcacuucuu

SEQ ID NO: 3657 - RNA, 22 nt, Homo sapiens
aagaagugcaccauguuuguuu

SEQ ID NO: 3658 - RNA, 22 nt, Homo sapiens
gaaguugcccauguuauuuucg

SEQ ID NO: 3659 - RNA, 22 nt, Homo sapiens
cgaaaauaacaugggcaacuuc

SEQ ID NO: 3660 - RNA, 21 nt, Homo sapiens
aaucauucacggacaacacuu

SEQ ID NO: 3661 - RNA, 21 nt, Homo sapiens
aaguguuguccgugaaugauu

SEQ ID NO: 3662 - RNA, 22 nt, Homo sapiens
gaaguuguucgugguggauucg

SEQ ID NO: 3663 - RNA, 22 nt, Homo sapiens
cgaauccaccacgaacaacuuc

SEQ ID NO: 3664 - RNA, 23 nt, Homo sapiens
ccuccguguuaccuguccucuag

SEQ ID NO: 3665 - RNA, 23 nt, Homo sapiens
cuagaggacagguaacacggagg

SEQ ID NO: 3666 - RNA, 23 nt, Homo sapiens
ugaggauggauagcaaggaagcc

SEQ ID NO: 3667 - RNA, 23 nt, Homo sapiens
ggcuuccuugcuauccauccuca

SEQ ID NO: 3668 - RNA, 22 nt, Homo sapiens
uucagaucccagcggugccucu

SEQ ID NO: 3669 - RNA, 22 nt, Homo sapiens
agaggcaccgcugggaucugaa

SEQ ID NO: 3670 - RNA, 19 nt, Homo sapiens
guccuaggaggcuccucug

SEQ ID NO: 3671 - RNA, 19 nt, Homo sapiens
cagaggagccuccuaggac

SEQ ID NO: 3672 - RNA, 21 nt, Homo sapiens
caauucucaaaggagccuccc

SEQ ID NO: 3673 - RNA, 21 nt, Homo sapiens
gggaggcuccuuugagaauug

SEQ ID NO: 3674 - RNA, 21 nt, Homo sapiens
guuggggugcaggggucugcu

SEQ ID NO: 3675 - RNA, 21 nt, Homo sapiens
agcagaccccugcaccccaac

SEQ ID NO: 3676 - RNA, 22 nt, Homo sapiens
uuuccggcucgcgugggugugu

SEQ ID NO: 3677 - RNA, 22 nt, Homo sapiens
acacacccacgcgagccggaaa

SEQ ID NO: 3678 - RNA, 23 nt, Homo sapiens
ugagugugugugugugagugugu

SEQ ID NO: 3679 - RNA, 23 nt, Homo sapiens
acacacucacacacacacacuca

SEQ ID NO: 3680 - RNA, 22 nt, Homo sapiens
agugggaggccagggcacggca

SEQ ID NO: 3681 - RNA, 22 nt, Homo sapiens
ugccgugcccuggccucccacu

SEQ ID NO: 3682 - RNA, 20 nt, Homo sapiens
ugagcccuguccucccgcag

SEQ ID NO: 3683 - RNA, 20 nt, Homo sapiens
cugcgggaggacagggcuca

SEQ ID NO: 3684 - RNA, 23 nt, Homo sapiens
aagugccgccaucuuuugagugu

SEQ ID NO: 3685 - RNA, 23 nt, Homo sapiens
acacucaaaagauggcggcacuu

SEQ ID NO: 3686 - RNA, 20 nt, Homo sapiens
acucaaacugugggggcacu

SEQ ID NO: 3687 - RNA, 20 nt, Homo sapiens
agugcccccacaguuugagu

SEQ ID NO: 3688 - RNA, 23 nt, Homo sapiens
aagugcccccacaguuugagugc

SEQ ID NO: 3689 - RNA, 23 nt, Homo sapiens
gcacucaaacugugggggcacuu

SEQ ID NO: 3690 - RNA, 22 nt, Homo sapiens
acucaaaagauggcggcacuuu

SEQ ID NO: 3691 - RNA, 22 nt, Homo sapiens
aaagugccgccaucuuuugagu

SEQ ID NO: 3692 - RNA, 22 nt, Homo sapiens
aaaccuguguuguucaagaguc

SEQ ID NO: 3693 - RNA, 22 nt, Homo sapiens
gacucuugaacaacacagguuu

SEQ ID NO: 3694 - RNA, 22 nt, Homo sapiens
acaguagagggaggaaucgcag

SEQ ID NO: 3695 - RNA, 22 nt, Homo sapiens
cugcgauuccucccucuacugu

SEQ ID NO: 3696 - RNA, 22 nt, Homo sapiens
gugaaauguuuaggaccacuag

SEQ ID NO: 3697 - RNA, 22 nt, Homo sapiens
cuagugguccuaaacauuucac

SEQ ID NO: 3698 - RNA, 23 nt, Homo sapiens
uugaacuguuaagaaccacugga

SEQ ID NO: 3699 - RNA, 23 nt, Homo sapiens
uccagugguucuuaacaguucaa

SEQ ID NO: 3700 - RNA, 22 nt, Homo sapiens
uagugguccuaaacauuucaca

SEQ ID NO: 3701 - RNA, 22 nt, Homo sapiens
ugugaaauguuuaggaccacua

SEQ ID NO: 3702 - RNA, 21 nt, Homo sapiens
ugcaggaccaagaugagcccu

SEQ ID NO: 3703 - RNA, 21 nt, Homo sapiens
agggcucaucuugguccugca

SEQ ID NO: 3704 - RNA, 21 nt, Homo sapiens
cucccacaugcaggguuugca

SEQ ID NO: 3705 - RNA, 21 nt, Homo sapiens
ugcaaacccugcaugugggag

SEQ ID NO: 3706 - RNA, 21 nt, Homo sapiens
caucccuugcaugguggaggg

SEQ ID NO: 3707 - RNA, 21 nt, Homo sapiens
cccuccaccaugcaagggaug

SEQ ID NO: 3708 - RNA, 22 nt, Homo sapiens
aaaaugaaaugagcccagccca

SEQ ID NO: 3709 - RNA, 22 nt, Homo sapiens
ugggcugggcucauuucauuuu

SEQ ID NO: 3710 - RNA, 21 nt, Homo sapiens
agccgcggggaucgccgaggg

SEQ ID NO: 3711 - RNA, 21 nt, Homo sapiens
cccucggcgauccccgcggcu

SEQ ID NO: 3712 - RNA, 19 nt, Homo sapiens
agggaccugagugucuaag

SEQ ID NO: 3713 - RNA, 19 nt, Homo sapiens
cuuagacacucaggucccu

SEQ ID NO: 3714 - RNA, 19 nt, Homo sapiens
aggugugucuguagagucc

SEQ ID NO: 3715 - RNA, 19 nt, Homo sapiens
ggacucuacagacacaccu

SEQ ID NO: 3716 - RNA, 24 nt, Homo sapiens
cauagcccggucgcugguacauga

SEQ ID NO: 3717 - RNA, 24 nt, Homo sapiens
ucauguaccagcgaccgggcuaug

SEQ ID NO: 3718 - RNA, 18 nt, Homo sapiens
cggcuggaggugugagga

SEQ ID NO: 3719 - RNA, 18 nt, Homo sapiens
uccucacaccuccagccg

SEQ ID NO: 3720 - RNA, 18 nt, Homo sapiens
cuaagaaguugacugaag

SEQ ID NO: 3721 - RNA, 18 nt, Homo sapiens
cuucagucaacuucuuag

SEQ ID NO: 3722 - RNA, 19 nt, Homo sapiens
gacuggacaagcugaggaa

SEQ ID NO: 3723 - RNA, 19 nt, Homo sapiens
uuccucagcuuguccaguc

SEQ ID NO: 3724 - RNA, 21 nt, Homo sapiens
gcuugucgcugcgguguugcu

SEQ ID NO: 3725 - RNA, 21 nt, Homo sapiens
agcaacaccgcagcgacaagc

SEQ ID NO: 3726 - RNA, 17 nt, Homo sapiens
ggcgggugcgggggugg

SEQ ID NO: 3727 - RNA, 17 nt, Homo sapiens
ccacccccgcacccgcc

SEQ ID NO: 3728 - RNA, 21 nt, Homo sapiens
ugugucccauuauuggugauu

SEQ ID NO: 3729 - RNA, 21 nt, Homo sapiens
aaucaccaauaaugggacaca

SEQ ID NO: 3730 - RNA, 22 nt, Homo sapiens
uuuaagaaaacaccauggagau

SEQ ID NO: 3731 - RNA, 22 nt, Homo sapiens
aucuccaugguguuuucuuaaa

SEQ ID NO: 3732 - RNA, 22 nt, Homo sapiens
gcuauuucacgacaccaggguu

SEQ ID NO: 3733 - RNA, 22 nt, Homo sapiens
aacccuggugucgugaaauagc

SEQ ID NO: 3734 - RNA, 23 nt, Homo sapiens
agcugguguugugaaucaggccg

SEQ ID NO: 3735 - RNA, 23 nt, Homo sapiens
cggccugauucacaacaccagcu

SEQ ID NO: 3736 - RNA, 21 nt, Homo sapiens
aauaauacaugguugaucuuu

SEQ ID NO: 3737 - RNA, 21 nt, Homo sapiens
aaagaucaaccauguauuauu

SEQ ID NO: 3738 - RNA, 22 nt, Homo sapiens
agaucgaccguguuauauucgc

SEQ ID NO: 3739 - RNA, 22 nt, Homo sapiens
gcgaauauaacacggucgaucu

SEQ ID NO: 3740 - RNA, 22 nt, Homo sapiens
aaucaugugcagugccaauaug

SEQ ID NO: 3741 - RNA, 22 nt, Homo sapiens
cauauuggcacugcacaugauu

SEQ ID NO: 3742 - RNA, 23 nt, Homo sapiens
uuuggcacuagcacauuuuugcu

SEQ ID NO: 3743 - RNA, 23 nt, Homo sapiens
agcaaaaaugugcuagugccaaa

SEQ ID NO: 3744 - RNA, 22 nt, Homo sapiens
uccuguacugagcugccccgag

SEQ ID NO: 3745 - RNA, 22 nt, Homo sapiens
cucggggcagcucaguacagga

SEQ ID NO: 3746 - RNA, 22 nt, Homo sapiens
gcuacuucacaacaccagggcc

SEQ ID NO: 3747 - RNA, 22 nt, Homo sapiens
ggcccugguguugugaaguagc

SEQ ID NO: 3748 - RNA, 22 nt, Homo sapiens
caucaucgucucaaaugagucu

SEQ ID NO: 3749 - RNA, 22 nt, Homo sapiens
agacucauuugagacgaugaug

SEQ ID NO: 3750 - RNA, 23 nt, Homo sapiens
acuccauuuguuuugaugaugga

SEQ ID NO: 3751 - RNA, 23 nt, Homo sapiens
uccaucaucaaaacaaauggagu

SEQ ID NO: 3752 - RNA, 22 nt, Homo sapiens
cuccuacauauuagcauuaaca

SEQ ID NO: 3753 - RNA, 22 nt, Homo sapiens
uguuaaugcuaauauguaggag

SEQ ID NO: 3754 - RNA, 23 nt, Homo sapiens
uuaaugcuaaucgugauaggggu

SEQ ID NO: 3755 - RNA, 23 nt, Homo sapiens
accccuaucacgauuagcauuaa

SEQ ID NO: 3756 - RNA, 22 nt, Homo sapiens
agaucagaaggugauuguggcu

SEQ ID NO: 3757 - RNA, 22 nt, Homo sapiens
agccacaaucaccuucugaucu

SEQ ID NO: 3758 - RNA, 22 nt, Homo sapiens
uacugcagacguggcaaucaug

SEQ ID NO: 3759 - RNA, 22 nt, Homo sapiens
caugauugccacgucugcagua

SEQ ID NO: 3760 - RNA, 21 nt, Homo sapiens
guuagggccaacaucucuugg

SEQ ID NO: 3761 - RNA, 21 nt, Homo sapiens
ccaagagauguuggcccuaac

SEQ ID NO: 3762 - RNA, 21 nt, Homo sapiens
aacauagaggaaauuccacgu

SEQ ID NO: 3763 - RNA, 21 nt, Homo sapiens
acguggaauuuccucuauguu

SEQ ID NO: 3764 - RNA, 21 nt, Homo sapiens
gguggauauuccuucuauguu

SEQ ID NO: 3765 - RNA, 21 nt, Homo sapiens
aacauagaaggaauauccacc

SEQ ID NO: 3766 - RNA, 23 nt, Homo sapiens
ucauagcccuguacaaugcugcu

SEQ ID NO: 3767 - RNA, 23 nt, Homo sapiens
agcagcauuguacagggcuauga

SEQ ID NO: 3768 - RNA, 22 nt, Homo sapiens
uaacacugucugguaaagaugg

SEQ ID NO: 3769 - RNA, 22 nt, Homo sapiens
ccaucuuuaccagacaguguua

SEQ ID NO: 3770 - RNA, 22 nt, Homo sapiens
caucuuccaguacaguguugga

SEQ ID NO: 3771 - RNA, 22 nt, Homo sapiens
uccaacacuguacuggaagaug

SEQ ID NO: 3772 - RNA, 22 nt, Homo sapiens
aacuggccuacaaagucccagu

SEQ ID NO: 3773 - RNA, 22 nt, Homo sapiens
acugggacuuuguaggccaguu

SEQ ID NO: 3774 - RNA, 22 nt, Homo sapiens
ugggucuuugcgggcgagauga

SEQ ID NO: 3775 - RNA, 22 nt, Homo sapiens
ucaucucgcccgcaaagaccca

SEQ ID NO: 3776 - RNA, 21 nt, Homo sapiens
augaccuaugaauugacagac

SEQ ID NO: 3777 - RNA, 21 nt, Homo sapiens
gucugucaauucauaggucau

SEQ ID NO: 3778 - RNA, 22 nt, Homo sapiens
aagcugccaguugaagaacugu

SEQ ID NO: 3779 - RNA, 22 nt, Homo sapiens
acaguucuucaacuggcagcuu

SEQ ID NO: 3780 - RNA, 22 nt, Homo sapiens
aguucuucaguggcaagcuuua

SEQ ID NO: 3781 - RNA, 22 nt, Homo sapiens
uaaagcuugccacugaagaacu

SEQ ID NO: 3782 - RNA, 22 nt, Homo sapiens
acagauucgauucuaggggaau

SEQ ID NO: 3783 - RNA, 22 nt, Homo sapiens
auuccccuagaaucgaaucugu

SEQ ID NO: 3784 - RNA, 23 nt, Homo sapiens
uacccuguagaaccgaauuugug

SEQ ID NO: 3785 - RNA, 23 nt, Homo sapiens
cacaaauucgguucuacagggua

SEQ ID NO: 3786 - RNA, 22 nt, Homo sapiens
uagcagcacguaaauauuggcg

SEQ ID NO: 3787 - RNA, 22 nt, Homo sapiens
cgccaauauuuacgugcugcua

SEQ ID NO: 3788 - RNA, 21 nt, Homo sapiens
ugagaugaagcacuguagcuc

SEQ ID NO: 3789 - RNA, 21 nt, Homo sapiens
gagcuacagugcuucaucuca

SEQ ID NO: 3790 - RNA, 22 nt, Homo sapiens
ggugcagugcugcaucucuggu

SEQ ID NO: 3791 - RNA, 22 nt, Homo sapiens
accagagaugcagcacugcacc

SEQ ID NO: 3792 - RNA, 21 nt, Homo sapiens
uugcucacuguucuucccuag

SEQ ID NO: 3793 - RNA, 21 nt, Homo sapiens
cuagggaagaacagugagcaa

SEQ ID NO: 3794 - RNA, 18 nt, Homo sapiens
cagggucagcugagcaug

SEQ ID NO: 3795 - RNA, 18 nt, Homo sapiens
caugcucagcugacccug

SEQ ID NO: 3796 - RNA, 21 nt, Homo sapiens
aagcauucuuucauugguugg

SEQ ID NO: 3797 - RNA, 21 nt, Homo sapiens
ccaaccaaugaaagaaugcuu

SEQ ID NO: 3798 - RNA, 21 nt, Homo sapiens
ccgucgccgccacccgagccg

SEQ ID NO: 3799 - RNA, 21 nt, Homo sapiens
cggcucggguggcggcgacgg

SEQ ID NO: 3800 - RNA, 27 nt, Homo sapiens
cacuguaggugauggugagagugggca

SEQ ID NO: 3801 - RNA, 27 nt, Homo sapiens
ugcccacucucaccaucaccuacagug

SEQ ID NO: 3802 - RNA, 23 nt, Homo sapiens
gggaugguagaccggugacgugc

SEQ ID NO: 3803 - RNA, 23 nt, Homo sapiens
gcacgucaccggucuaccauccc

SEQ ID NO: 3804 - RNA, 21 nt, Homo sapiens
uaggacacauggucuacuucu

SEQ ID NO: 3805 - RNA, 21 nt, Homo sapiens
agaaguagaccauguguccua

SEQ ID NO: 3806 - RNA, 22 nt, Homo sapiens
cuccugagccauucugagccuc

SEQ ID NO: 3807 - RNA, 22 nt, Homo sapiens
gaggcucagaauggcucaggag

SEQ ID NO: 3808 - RNA, 21 nt, Homo sapiens
gugccagcugcagugggggag

SEQ ID NO: 3809 - RNA, 21 nt, Homo sapiens
cucccccacugcagcuggcac

SEQ ID NO: 3810 - RNA, 21 nt, Homo sapiens
cccggagccaggaugcagcuc

SEQ ID NO: 3811 - RNA, 21 nt, Homo sapiens
gagcugcauccuggcuccggg

SEQ ID NO: 3812 - RNA, 21 nt, Homo sapiens
ucguggccuggucuccauuau

SEQ ID NO: 3813 - RNA, 21 nt, Homo sapiens
auaauggagaccaggccacga

SEQ ID NO: 3814 - RNA, 20 nt, Homo sapiens
ucugcaggguuugcuuugag

SEQ ID NO: 3815 - RNA, 20 nt, Homo sapiens
cucaaagcaaacccugcaga

SEQ ID NO: 3816 - RNA, 21 nt, Homo sapiens
uguucauguagauguuuaagc

SEQ ID NO: 3817 - RNA, 21 nt, Homo sapiens
gcuuaaacaucuacaugaaca

SEQ ID NO: 3818 - RNA, 18 nt, Homo sapiens
ucagcuggcccucauuuc

SEQ ID NO: 3819 - RNA, 18 nt, Homo sapiens
gaaaugagggccagcuga

SEQ ID NO: 3820 - RNA, 21 nt, Homo sapiens
uggcagggaggcugggagggg

SEQ ID NO: 3821 - RNA, 21 nt, Homo sapiens
ccccucccagccucccugcca

SEQ ID NO: 3822 - RNA, 20 nt, Homo sapiens
ucacuguucagacaggcgga

SEQ ID NO: 3823 - RNA, 20 nt, Homo sapiens
uccgccugucugaacaguga

SEQ ID NO: 3824 - RNA, 21 nt, Homo sapiens
ccccaccuccucucuccucag

SEQ ID NO: 3825 - RNA, 21 nt, Homo sapiens
cugaggagagaggaggugggg

SEQ ID NO: 3826 - RNA, 19 nt, Homo sapiens
gugaggacucgggaggugg

SEQ ID NO: 3827 - RNA, 19 nt, Homo sapiens
ccaccucccgaguccucac

SEQ ID NO: 3828 - RNA, 22 nt, Homo sapiens
ugagccccugugccgcccccag

SEQ ID NO: 3829 - RNA, 22 nt, Homo sapiens
cugggggcggcacaggggcuca

SEQ ID NO: 3830 - RNA, 22 nt, Homo sapiens
guggguacggcccagugggggg

SEQ ID NO: 3831 - RNA, 22 nt, Homo sapiens
ccccccacugggccguacccac

SEQ ID NO: 3832 - RNA, 22 nt, Homo sapiens
ucaccagcccuguguucccuag

SEQ ID NO: 3833 - RNA, 22 nt, Homo sapiens
cuagggaacacagggcugguga

SEQ ID NO: 3834 - RNA, 26 nt, Homo sapiens
gugagggcaugcaggccuggaugggg

SEQ ID NO: 3835 - RNA, 26 nt, Homo sapiens
ccccauccaggccugcaugcccucac

SEQ ID NO: 3836 - RNA, 23 nt, Homo sapiens
cucucaccacugcccucccacag

SEQ ID NO: 3837 - RNA, 23 nt, Homo sapiens
cugugggagggcaguggugagag

SEQ ID NO: 3838 - RNA, 24 nt, Homo sapiens
guggguaggguuugggggagagcg

SEQ ID NO: 3839 - RNA, 24 nt, Homo sapiens
cgcucucccccaaacccuacccac

SEQ ID NO: 3840 - RNA, 20 nt, Homo sapiens
gugucugggcggacagcugc

SEQ ID NO: 3841 - RNA, 20 nt, Homo sapiens
gcagcuguccgcccagacac

SEQ ID NO: 3842 - RNA, 20 nt, Homo sapiens
cuuccucgucugucugcccc

SEQ ID NO: 3843 - RNA, 20 nt, Homo sapiens
ggggcagacagacgaggaag

SEQ ID NO: 3844 - RNA, 23 nt, Homo sapiens
gugagugggagccccagugugug

SEQ ID NO: 3845 - RNA, 23 nt, Homo sapiens
cacacacuggggcucccacucac

SEQ ID NO: 3846 - RNA, 27 nt, Homo sapiens
accuucuuguauaagcacugugcuaaa

SEQ ID NO: 3847 - RNA, 27 nt, Homo sapiens
uuuagcacagugcuuauacaagaaggu

SEQ ID NO: 3848 - RNA, 22 nt, Homo sapiens
ggcgacaaaacgagacccuguc

SEQ ID NO: 3849 - RNA, 22 nt, Homo sapiens
gacagggucucguuuugucgcc

SEQ ID NO: 3850 - RNA, 22 nt, Homo sapiens
uugcuugaacccaggaagugga

SEQ ID NO: 3851 - RNA, 22 nt, Homo sapiens
uccacuuccuggguucaagcaa

SEQ ID NO: 3852 - RNA, 19 nt, Homo sapiens
ggagauggagguugcagug

SEQ ID NO: 3853 - RNA, 19 nt, Homo sapiens
cacugcaaccuccaucucc

SEQ ID NO: 3854 - RNA, 21 nt, Homo sapiens
accacugcacuccagccugag

SEQ ID NO: 3855 - RNA, 21 nt, Homo sapiens
cucaggcuggagugcaguggu

SEQ ID NO: 3856 - RNA, 22 nt, Homo sapiens
ggugguugaggcugcaguaagu

SEQ ID NO: 3857 - RNA, 22 nt, Homo sapiens
acuuacugcagccucaaccacc

SEQ ID NO: 3858 - RNA, 17 nt, Homo sapiens
ucgccuccuccucuccc

SEQ ID NO: 3859 - RNA, 17 nt, Homo sapiens
gggagaggaggaggcga

SEQ ID NO: 3860 - RNA, 22 nt, Homo sapiens
ucuauacagacccuggcuuuuc

SEQ ID NO: 3861 - RNA, 22 nt, Homo sapiens
gaaaagccagggucuguauaga

SEQ ID NO: 3862 - RNA, 22 nt, Homo sapiens
ucugggcaacaaagugagaccu

SEQ ID NO: 3863 - RNA, 22 nt, Homo sapiens
aggucucacuuuguugcccaga

SEQ ID NO: 3864 - RNA, 21 nt, Homo sapiens
gaucucacuuuguugcccagg

SEQ ID NO: 3865 - RNA, 21 nt, Homo sapiens
ccugggcaacaaagugagauc

SEQ ID NO: 3866 - RNA, 20 nt, Homo sapiens
ucgcgccccggcucccguuc

SEQ ID NO: 3867 - RNA, 20 nt, Homo sapiens
gaacgggagccggggcgcga

SEQ ID NO: 3868 - RNA, 25 nt, Homo sapiens
ugggaacggguuccggcagacgcug

SEQ ID NO: 3869 - RNA, 25 nt, Homo sapiens
cagcgucugccggaacccguuccca

SEQ ID NO: 3870 - RNA, 21 nt, Homo sapiens
uuaggccgcagaucuggguga

SEQ ID NO: 3871 - RNA, 21 nt, Homo sapiens
ucacccagaucugcggccuaa

SEQ ID NO: 3872 - RNA, 22 nt, Homo sapiens
aauaggccacggaucugggcaa

SEQ ID NO: 3873 - RNA, 22 nt, Homo sapiens
uugcccagauccguggccuauu

SEQ ID NO: 3874 - RNA, 21 nt, Homo sapiens
cacccagaucugcggccuaau

SEQ ID NO: 3875 - RNA, 21 nt, Homo sapiens
auuaggccgcagaucugggug

SEQ ID NO: 3876 - RNA, 22 nt, Homo sapiens
uuagggcccuggcuccaucucc

SEQ ID NO: 3877 - RNA, 22 nt, Homo sapiens
ggagauggagccagggcccuaa

SEQ ID NO: 3878 - RNA, 22 nt, Homo sapiens
uucauucggcuguccagaugua

SEQ ID NO: 3879 - RNA, 22 nt, Homo sapiens
uacaucuggacagccgaaugaa

SEQ ID NO: 3880 - RNA, 24 nt, Homo sapiens
uugcagcugccugggagugacuuc

SEQ ID NO: 3881 - RNA, 24 nt, Homo sapiens
gaagucacucccaggcagcugcaa

SEQ ID NO: 3882 - RNA, 21 nt, Homo sapiens
uugggacauacuuaugcuaaa

SEQ ID NO: 3883 - RNA, 21 nt, Homo sapiens
uuuagcauaaguaugucccaa

SEQ ID NO: 3884 - RNA, 22 nt, Homo sapiens
ucucacuguagccucgaacccc

SEQ ID NO: 3885 - RNA, 22 nt, Homo sapiens
gggguucgaggcuacagugaga

SEQ ID NO: 3886 - RNA, 22 nt, Homo sapiens
uuugaggcuacagugagaugug

SEQ ID NO: 3887 - RNA, 22 nt, Homo sapiens
cacaucucacuguagccucaaa

SEQ ID NO: 3888 - RNA, 18 nt, Homo sapiens
cagggaggugaaugugau

SEQ ID NO: 3889 - RNA, 18 nt, Homo sapiens
aucacauucaccucccug

SEQ ID NO: 3890 - RNA, 19 nt, Homo sapiens
gaugaugcugcugaugcug

SEQ ID NO: 3891 - RNA, 19 nt, Homo sapiens
cagcaucagcagcaucauc

SEQ ID NO: 3892 - RNA, 24 nt, Homo sapiens
ccagacagaauucuaugcacuuuc

SEQ ID NO: 3893 - RNA, 24 nt, Homo sapiens
gaaagugcauagaauucugucugg

SEQ ID NO: 3894 - RNA, 22 nt, Homo sapiens
cuccuggggcccgcacucucgc

SEQ ID NO: 3895 - RNA, 22 nt, Homo sapiens
gcgagagugcgggccccaggag

SEQ ID NO: 3896 - RNA, 21 nt, Homo sapiens
cuccguuugccuguuucgcug

SEQ ID NO: 3897 - RNA, 21 nt, Homo sapiens
cagcgaaacaggcaaacggag

SEQ ID NO: 3898 - RNA, 22 nt, Homo sapiens
cucggcgcggggcgcgggcucc

SEQ ID NO: 3899 - RNA, 22 nt, Homo sapiens
ggagcccgcgccccgcgccgag

SEQ ID NO: 3900 - RNA, 21 nt, Homo sapiens
gcccuccgcccgugcaccccg

SEQ ID NO: 3901 - RNA, 21 nt, Homo sapiens
cggggugcacgggcggagggc

SEQ ID NO: 3902 - RNA, 22 nt, Homo sapiens
gcccgcguguggagccaggugu

SEQ ID NO: 3903 - RNA, 22 nt, Homo sapiens
acaccuggcuccacacgcgggc

SEQ ID NO: 3904 - RNA, 22 nt, Homo sapiens
aaaaccgucuaguuacaguugu

SEQ ID NO: 3905 - RNA, 22 nt, Homo sapiens
acaacuguaacuagacgguuuu

SEQ ID NO: 3906 - RNA, 18 nt, Homo sapiens
uccagugcccuccucucc

SEQ ID NO: 3907 - RNA, 18 nt, Homo sapiens
ggagaggagggcacugga

SEQ ID NO: 3908 - RNA, 18 nt, Homo sapiens
ugaggcaguagauugaau

SEQ ID NO: 3909 - RNA, 18 nt, Homo sapiens
auucaaucuacugccuca

SEQ ID NO: 3910 - RNA, 22 nt, Homo sapiens
aggggcuggcuuuccucugguc

SEQ ID NO: 3911 - RNA, 22 nt, Homo sapiens
gaccagaggaaagccagccccu

SEQ ID NO: 3912 - RNA, 22 nt, Homo sapiens
uggagagaaaggcaguuccuga

SEQ ID NO: 3913 - RNA, 22 nt, Homo sapiens
ucaggaacugccuuucucucca

SEQ ID NO: 3914 - RNA, 22 nt, Homo sapiens
ucgugucuuguguugcagccgg

SEQ ID NO: 3915 - RNA, 22 nt, Homo sapiens
ccggcugcaacacaagacacga

SEQ ID NO: 3916 - RNA, 22 nt, Homo sapiens
ggcuacaacacaggacccgggc

SEQ ID NO: 3917 - RNA, 22 nt, Homo sapiens
gcccggguccuguguuguagcc

SEQ ID NO: 3918 - RNA, 21 nt, Homo sapiens
cggcggggacggcgauugguc

SEQ ID NO: 3919 - RNA, 21 nt, Homo sapiens
gaccaaucgccguccccgccg

SEQ ID NO: 3920 - RNA, 22 nt, Homo sapiens
cgcaggggccgggugcucaccg

SEQ ID NO: 3921 - RNA, 22 nt, Homo sapiens
cggugagcacccggccccugcg

SEQ ID NO: 3922 - RNA, 21 nt, Homo sapiens
ugagugccggugccugcccug

SEQ ID NO: 3923 - RNA, 21 nt, Homo sapiens
cagggcaggcaccggcacuca

SEQ ID NO: 3924 - RNA, 22 nt, Homo sapiens
gcugcgcuuggauuucgucccc

SEQ ID NO: 3925 - RNA, 22 nt, Homo sapiens
ggggacgaaauccaagcgcagc

SEQ ID NO: 3926 - RNA, 23 nt, Homo sapiens
caacggaaucccaaaagcagcug

SEQ ID NO: 3927 - RNA, 23 nt, Homo sapiens
cagcugcuuuugggauuccguug

SEQ ID NO: 3928 - RNA, 22 nt, Homo sapiens
ucaggccaggcacaguggcuca

SEQ ID NO: 3929 - RNA, 22 nt, Homo sapiens
ugagccacugugccuggccuga

SEQ ID NO: 3930 - RNA, 19 nt, Homo sapiens
accgugcaaagguagcaua

SEQ ID NO: 3931 - RNA, 19 nt, Homo sapiens
uaugcuaccuuugcacggu

SEQ ID NO: 3932 - RNA, 20 nt, Homo sapiens
ccuccugcccuccuugcugu

SEQ ID NO: 3933 - RNA, 20 nt, Homo sapiens
acagcaaggagggcaggagg

SEQ ID NO: 3934 - RNA, 20 nt, Homo sapiens
uguuuugauaacaguaaugu

SEQ ID NO: 3935 - RNA, 20 nt, Homo sapiens
acauuacuguuaucaaaaca

SEQ ID NO: 3936 - RNA, 23 nt, Homo sapiens
guguuaauuaaaccucuauuuac

SEQ ID NO: 3937 - RNA, 23 nt, Homo sapiens
guaaauagagguuuaauuaacac

SEQ ID NO: 3938 - RNA, 23 nt, Homo sapiens
cuguaauauaaauuuaauuuauu

SEQ ID NO: 3939 - RNA, 23 nt, Homo sapiens
aauaaauuaaauuuauauuacag

SEQ ID NO: 3940 - RNA, 22 nt, Homo sapiens
uuggggaaacggccgcugagug

SEQ ID NO: 3941 - RNA, 22 nt, Homo sapiens
cacucagcggccguuuccccaa

SEQ ID NO: 3942 - RNA, 21 nt, Homo sapiens
ccucccaugccaagaacuccc

SEQ ID NO: 3943 - RNA, 21 nt, Homo sapiens
gggaguucuuggcaugggagg

SEQ ID NO: 3944 - RNA, 21 nt, Homo sapiens
gguucuuagcauaggaggucu

SEQ ID NO: 3945 - RNA, 21 nt, Homo sapiens
agaccuccuaugcuaagaacc

SEQ ID NO: 3946 - RNA, 21 nt, Homo sapiens
uguucucuuugccaaggacag

SEQ ID NO: 3947 - RNA, 21 nt, Homo sapiens
cuguccuuggcaaagagaaca

SEQ ID NO: 3948 - RNA, 22 nt, Homo sapiens
aaaucucugcaggcaaauguga

SEQ ID NO: 3949 - RNA, 22 nt, Homo sapiens
ucacauuugccugcagagauuu

SEQ ID NO: 3950 - RNA, 22 nt, Homo sapiens
caugguucugucaagcaccgcg

SEQ ID NO: 3951 - RNA, 22 nt, Homo sapiens
cgcggugcuugacagaaccaug

SEQ ID NO: 3952 - RNA, 21 nt, Homo sapiens
uugugcuugaucuaaccaugu

SEQ ID NO: 3953 - RNA, 21 nt, Homo sapiens
acaugguuagaucaagcacaa

SEQ ID NO: 3954 - RNA, 22 nt, Homo sapiens
ucugcaagugucagaggcgagg

SEQ ID NO: 3955 - RNA, 22 nt, Homo sapiens
ccucgccucugacacuugcaga

SEQ ID NO: 3956 - RNA, 22 nt, Homo sapiens
gagagcaguguguguugccugg

SEQ ID NO: 3957 - RNA, 22 nt, Homo sapiens
ccaggcaacacacacugcucuc

SEQ ID NO: 3958 - RNA, 22 nt, Homo sapiens
aucacauugccagugauuaccc

SEQ ID NO: 3959 - RNA, 22 nt, Homo sapiens
ggguaaucacuggcaaugugau

SEQ ID NO: 3960 - RNA, 22 nt, Homo sapiens
agcagaggcagagaggcucagg

SEQ ID NO: 3961 - RNA, 22 nt, Homo sapiens
ccugagccucucugccucugcu

SEQ ID NO: 3962 - RNA, 23 nt, Homo sapiens
ugaggcucuguuagccuuggcuc

SEQ ID NO: 3963 - RNA, 23 nt, Homo sapiens
gagccaaggcuaacagagccuca

SEQ ID NO: 3964 - RNA, 22 nt, Homo sapiens
uaucauggaguugguaaagcac

SEQ ID NO: 3965 - RNA, 22 nt, Homo sapiens
gugcuuuaccaacuccaugaua

SEQ ID NO: 3966 - RNA, 22 nt, Homo sapiens
guuuuaccaccuccaggagacu

SEQ ID NO: 3967 - RNA, 22 nt, Homo sapiens
agucuccuggaggugguaaaac

SEQ ID NO: 3968 - RNA, 22 nt, Homo sapiens
cgccucuucagcgcugucuucc

SEQ ID NO: 3969 - RNA, 22 nt, Homo sapiens
ggaagacagcgcugaagaggcg

SEQ ID NO: 3970 - RNA, 23 nt, Homo sapiens
caggcagugacuguucagacguc

SEQ ID NO: 3971 - RNA, 23 nt, Homo sapiens
gacgucugaacagucacugccug

SEQ ID NO: 3972 - RNA, 23 nt, Homo sapiens
agaauugcguuuggacaaucagu

SEQ ID NO: 3973 - RNA, 23 nt, Homo sapiens
acugauuguccaaacgcaauucu

SEQ ID NO: 3974 - RNA, 22 nt, Homo sapiens
agauguccagccacaauucucg

SEQ ID NO: 3975 - RNA, 22 nt, Homo sapiens
cgagaauuguggcuggacaucu

SEQ ID NO: 3976 - RNA, 24 nt, Homo sapiens
agcagaagcagggagguucuccca

SEQ ID NO: 3977 - RNA, 24 nt, Homo sapiens
ugggagaaccucccugcuucugcu

SEQ ID NO: 3978 - RNA, 22 nt, Homo sapiens
uaugugggaugguaaaccgcuu

SEQ ID NO: 3979 - RNA, 22 nt, Homo sapiens
aagcgguuuaccaucccacaua

SEQ ID NO: 3980 - RNA, 22 nt, Homo sapiens
ugguuuaccgucccacauacau

SEQ ID NO: 3981 - RNA, 22 nt, Homo sapiens
auguaugugggacgguaaacca

SEQ ID NO: 3982 - RNA, 23 nt, Homo sapiens
cagugcaaugauauugucaaagc

SEQ ID NO: 3983 - RNA, 23 nt, Homo sapiens
gcuuugacaauaucauugcacug

SEQ ID NO: 3984 - RNA, 17 nt, Homo sapiens
uaauugcuuccauguuu

SEQ ID NO: 3985 - RNA, 17 nt, Homo sapiens
aaacauggaagcaauua

SEQ ID NO: 3986 - RNA, 23 nt, Homo sapiens
uugccacacugcaacaccuuaca

SEQ ID NO: 3987 - RNA, 23 nt, Homo sapiens
uguaagguguugcaguguggcaa

SEQ ID NO: 3988 - RNA, 21 nt, Homo sapiens
ucuggcuguuguggugugcaa

SEQ ID NO: 3989 - RNA, 21 nt, Homo sapiens
uugcacaccacaacagccaga

SEQ ID NO: 3990 - RNA, 22 nt, Homo sapiens
gauaucagcucaguaggcaccg

SEQ ID NO: 3991 - RNA, 22 nt, Homo sapiens
cggugccuacugagcugauauc

SEQ ID NO: 3992 - RNA, 21 nt, Homo sapiens
guuccugcugaacugagccag

SEQ ID NO: 3993 - RNA, 21 nt, Homo sapiens
cuggcucaguucagcaggaac

SEQ ID NO: 3994 - RNA, 20 nt, Homo sapiens
auauggguuuacuaguuggu

SEQ ID NO: 3995 - RNA, 20 nt, Homo sapiens
accaacuaguaaacccauau

SEQ ID NO: 3996 - RNA, 22 nt, Homo sapiens
ugcuaugccaacauauugccau

SEQ ID NO: 3997 - RNA, 22 nt, Homo sapiens
auggcaauauguuggcauagca

SEQ ID NO: 3998 - RNA, 21 nt, Homo sapiens
aggcaagaugcuggcauagcu

SEQ ID NO: 3999 - RNA, 21 nt, Homo sapiens
agcuaugccagcaucuugccu

SEQ ID NO: 4000 - RNA, 18 nt, Homo sapiens
cggggcggcaggggccuc

SEQ ID NO: 4001 - RNA, 18 nt, Homo sapiens
gaggccccugccgccccg

SEQ ID NO: 4002 - RNA, 19 nt, Homo sapiens
aaaagcuggguugagagga

SEQ ID NO: 4003 - RNA, 19 nt, Homo sapiens
uccucucaacccagcuuuu

SEQ ID NO: 4004 - RNA, 22 nt, Homo sapiens
cccaauacacggucgaccucuu

SEQ ID NO: 4005 - RNA, 22 nt, Homo sapiens
aagaggucgaccguguauuggg

SEQ ID NO: 4006 - RNA, 23 nt, Homo sapiens
agguuguccguggugaguucgca

SEQ ID NO: 4007 - RNA, 23 nt, Homo sapiens
ugcgaacucaccacggacaaccu

SEQ ID NO: 4008 - RNA, 23 nt, Homo sapiens
gcaaagcacacggccugcagaga

SEQ ID NO: 4009 - RNA, 23 nt, Homo sapiens
ucucugcaggccgugugcuuugc

SEQ ID NO: 4010 - RNA, 22 nt, Homo sapiens
ucucugggccugugucuuaggc

SEQ ID NO: 4011 - RNA, 22 nt, Homo sapiens
gccuaagacacaggcccagaga

SEQ ID NO: 4012 - RNA, 21 nt, Homo sapiens
gccccugggccuauccuagaa

SEQ ID NO: 4013 - RNA, 21 nt, Homo sapiens
uucuaggauaggcccaggggc

SEQ ID NO: 4014 - RNA, 22 nt, Homo sapiens
uccgucucaguuacuuuauagc

SEQ ID NO: 4015 - RNA, 22 nt, Homo sapiens
gcuauaaaguaacugagacgga

SEQ ID NO: 4016 - RNA, 22 nt, Homo sapiens
aacacaccuauucaaggauuca

SEQ ID NO: 4017 - RNA, 22 nt, Homo sapiens
ugaauccuugaauagguguguu

SEQ ID NO: 4018 - RNA, 24 nt, Homo sapiens
aauccuuggaaccuaggugugagu

SEQ ID NO: 4019 - RNA, 24 nt, Homo sapiens
acucacaccuagguuccaaggauu

SEQ ID NO: 4020 - RNA, 22 nt, Homo sapiens
uaaugccccuaaaaauccuuau

SEQ ID NO: 4021 - RNA, 22 nt, Homo sapiens
auaaggauuuuuaggggcauua

SEQ ID NO: 4022 - RNA, 23 nt, Homo sapiens
agggacuuuugggggcagaugug

SEQ ID NO: 4023 - RNA, 23 nt, Homo sapiens
cacaucugcccccaaaagucccu

SEQ ID NO: 4024 - RNA, 22 nt, Homo sapiens
uaaugccccuaaaaauccuuau

SEQ ID NO: 4025 - RNA, 22 nt, Homo sapiens
auaaggauuuuuaggggcauua

SEQ ID NO: 4026 - RNA, 22 nt, Homo sapiens
agggacuuucaggggcagcugu

SEQ ID NO: 4027 - RNA, 22 nt, Homo sapiens
acagcugccccugaaagucccu

SEQ ID NO: 4028 - RNA, 24 nt, Homo sapiens
gaaaaugaugaguagugacugaug

SEQ ID NO: 4029 - RNA, 24 nt, Homo sapiens
caucagucacuacucaucauuuuc

SEQ ID NO: 4030 - RNA, 23 nt, Homo sapiens
ugagcaccacacaggccgggcgc

SEQ ID NO: 4031 - RNA, 23 nt, Homo sapiens
gcgcccggccuguguggugcuca

SEQ ID NO: 4032 - RNA, 21 nt, Homo sapiens
gcuggucugcguggugcucgg

SEQ ID NO: 4033 - RNA, 21 nt, Homo sapiens
ccgagcaccacgcagaccagc

SEQ ID NO: 4034 - RNA, 22 nt, Homo sapiens
gccugcugggguggaaccuggu

SEQ ID NO: 4035 - RNA, 22 nt, Homo sapiens
accagguuccaccccagcaggc

SEQ ID NO: 4036 - RNA, 23 nt, Homo sapiens
gaagugcuucgauuuuggggugu

SEQ ID NO: 4037 - RNA, 23 nt, Homo sapiens
acaccccaaaaucgaagcacuuc

SEQ ID NO: 4038 - RNA, 22 nt, Homo sapiens
acucaaaaugggggcgcuuucc

SEQ ID NO: 4039 - RNA, 22 nt, Homo sapiens
ggaaagcgcccccauuuugagu

SEQ ID NO: 4040 - RNA, 22 nt, Homo sapiens
uauguaacaugguccacuaacu

SEQ ID NO: 4041 - RNA, 22 nt, Homo sapiens
aguuaguggaccauguuacaua

SEQ ID NO: 4042 - RNA, 21 nt, Homo sapiens
ugguagacuauggaacguagg

SEQ ID NO: 4043 - RNA, 21 nt, Homo sapiens
ccuacguuccauagucuacca

SEQ ID NO: 4044 - RNA, 22 nt, Homo sapiens
uguagauacgagcaccagccac

SEQ ID NO: 4045 - RNA, 22 nt, Homo sapiens
guggcuggugcucguaucuaca

SEQ ID NO: 4046 - RNA, 23 nt, Homo sapiens
acaggcggcuguagcaauggggg

SEQ ID NO: 4047 - RNA, 23 nt, Homo sapiens
cccccauugcuacagccgccugu

SEQ ID NO: 4048 - RNA, 22 nt, Homo sapiens
aauucccuuguagauaacccgg

SEQ ID NO: 4049 - RNA, 22 nt, Homo sapiens
ccggguuaucuacaagggaauu

SEQ ID NO: 4050 - RNA, 22 nt, Homo sapiens
uacgcgcagaccacaggauguc

SEQ ID NO: 4051 - RNA, 22 nt, Homo sapiens
gacauccuguggucugcgcgua

SEQ ID NO: 4052 - RNA, 22 nt, Homo sapiens
uuacacacaacugaggaucaua

SEQ ID NO: 4053 - RNA, 22 nt, Homo sapiens
uaugauccucaguuguguguaa

SEQ ID NO: 4054 - RNA, 23 nt, Homo sapiens
uagcccccaggcuucacuuggcg

SEQ ID NO: 4055 - RNA, 23 nt, Homo sapiens
cgccaagugaagccugggggcua

SEQ ID NO: 4056 - RNA, 23 nt, Homo sapiens
agggcauaggagaggguugauau

SEQ ID NO: 4057 - RNA, 23 nt, Homo sapiens
auaucaacccucuccuaugcccu

SEQ ID NO: 4058 - RNA, 22 nt, Homo sapiens
gaauguugcucggugaaccccu

SEQ ID NO: 4059 - RNA, 22 nt, Homo sapiens
agggguucaccgagcaacauuc

SEQ ID NO: 4060 - RNA, 23 nt, Homo sapiens
agguuacccgagcaacuuugcau

SEQ ID NO: 4061 - RNA, 23 nt, Homo sapiens
augcaaaguugcucggguaaccu

SEQ ID NO: 4062 - RNA, 22 nt, Homo sapiens
uauguaacacgguccacuaacc

SEQ ID NO: 4063 - RNA, 22 nt, Homo sapiens
gguuaguggaccguguuacaua

SEQ ID NO: 4064 - RNA, 21 nt, Homo sapiens
uaguagaccguauagcguacg

SEQ ID NO: 4065 - RNA, 21 nt, Homo sapiens
cguacgcuauacggucuacua

SEQ ID NO: 4066 - RNA, 23 nt, Homo sapiens
acuucaccugguccacuagccgu

SEQ ID NO: 4067 - RNA, 23 nt, Homo sapiens
acggcuaguggaccaggugaagu

SEQ ID NO: 4068 - RNA, 18 nt, Homo sapiens
guguucucugauggacag

SEQ ID NO: 4069 - RNA, 18 nt, Homo sapiens
cuguccaucagagaacac

SEQ ID NO: 4070 - RNA, 22 nt, Homo sapiens
caggucgucuugcagggcuucu

SEQ ID NO: 4071 - RNA, 22 nt, Homo sapiens
agaagcccugcaagacgaccug

SEQ ID NO: 4072 - RNA, 21 nt, Homo sapiens
ugucuugcaggccgucaugca

SEQ ID NO: 4073 - RNA, 21 nt, Homo sapiens
ugcaugacggccugcaagaca

SEQ ID NO: 4074 - RNA, 22 nt, Homo sapiens
aucaugaugggcuccucggugu

SEQ ID NO: 4075 - RNA, 22 nt, Homo sapiens
acaccgaggagcccaucaugau

SEQ ID NO: 4076 - RNA, 23 nt, Homo sapiens
uugcuaguugcacuccucucugu

SEQ ID NO: 4077 - RNA, 23 nt, Homo sapiens
acagagaggagugcaacuagcaa

SEQ ID NO: 4078 - RNA, 25 nt, Homo sapiens
uaggcaguguauugcuagcggcugu

SEQ ID NO: 4079 - RNA, 25 nt, Homo sapiens
acagccgcuagcaauacacugccua

SEQ ID NO: 4080 - RNA, 22 nt, Homo sapiens
auuggggacauuuugcauucau

SEQ ID NO: 4081 - RNA, 22 nt, Homo sapiens
augaaugcaaaauguccccaau

SEQ ID NO: 4082 - RNA, 22 nt, Homo sapiens
uuuugcgauguguuccuaauau

SEQ ID NO: 4083 - RNA, 22 nt, Homo sapiens
auauuaggaacacaucgcaaaa

SEQ ID NO: 4084 - RNA, 22 nt, Homo sapiens
uugggaucauuuugcauccaua

SEQ ID NO: 4085 - RNA, 22 nt, Homo sapiens
uauggaugcaaaaugaucccaa

SEQ ID NO: 4086 - RNA, 22 nt, Homo sapiens
uuuugcaauauguuccugaaua

SEQ ID NO: 4087 - RNA, 22 nt, Homo sapiens
uauucaggaacauauugcaaaa

SEQ ID NO: 4088 - RNA, 21 nt, Homo sapiens
gcaguccaugggcauauacac

SEQ ID NO: 4089 - RNA, 21 nt, Homo sapiens
guguauaugcccauggacugc

SEQ ID NO: 4090 - RNA, 22 nt, Homo sapiens
uaugugccuuuggacuacaucg

SEQ ID NO: 4091 - RNA, 22 nt, Homo sapiens
cgauguaguccaaaggcacaua

SEQ ID NO: 4092 - RNA, 23 nt, Homo sapiens
auacacauacacgcaacacacau

SEQ ID NO: 4093 - RNA, 23 nt, Homo sapiens
auguguguugcguguauguguau

SEQ ID NO: 4094 - RNA, 23 nt, Homo sapiens
uugcaugucagauuguaauuccc

SEQ ID NO: 4095 - RNA, 23 nt, Homo sapiens
gggaauuacaaucugacaugcaa

SEQ ID NO: 4096 - RNA, 21 nt, Homo sapiens
ucacuccucuccucccgucuu

SEQ ID NO: 4097 - RNA, 21 nt, Homo sapiens
aagacgggaggagaggaguga

SEQ ID NO: 4098 - RNA, 22 nt, Homo sapiens
ucaggcucaguccccucccgau

SEQ ID NO: 4099 - RNA, 22 nt, Homo sapiens
aucgggaggggacugagccuga

SEQ ID NO: 4100 - RNA, 22 nt, Homo sapiens
gucauacacggcucuccucucu

SEQ ID NO: 4101 - RNA, 22 nt, Homo sapiens
agagaggagagccguguaugac

SEQ ID NO: 4102 - RNA, 22 nt, Homo sapiens
agaggcuggccgugaugaauuc

SEQ ID NO: 4103 - RNA, 22 nt, Homo sapiens
gaauucaucacggccagccucu

SEQ ID NO: 4104 - RNA, 22 nt, Homo sapiens
aaucauacagggacauccaguu

SEQ ID NO: 4105 - RNA, 22 nt, Homo sapiens
aacuggaugucccuguaugauu

SEQ ID NO: 4106 - RNA, 22 nt, Homo sapiens
aaucguacagggucauccacuu

SEQ ID NO: 4107 - RNA, 22 nt, Homo sapiens
aaguggaugacccuguacgauu

SEQ ID NO: 4108 - RNA, 21 nt, Homo sapiens
uugaaaggcuauuucuugguc

SEQ ID NO: 4109 - RNA, 21 nt, Homo sapiens
gaccaagaaauagccuuucaa

SEQ ID NO: 4110 - RNA, 21 nt, Homo sapiens
cccagauaauggcacucucaa

SEQ ID NO: 4111 - RNA, 21 nt, Homo sapiens
uugagagugccauuaucuggg

SEQ ID NO: 4112 - RNA, 22 nt, Homo sapiens
caaccuggaggacuccaugcug

SEQ ID NO: 4113 - RNA, 22 nt, Homo sapiens
cagcauggaguccuccagguug

SEQ ID NO: 4114 - RNA, 20 nt, Homo sapiens
ccauggaucuccaggugggu

SEQ ID NO: 4115 - RNA, 20 nt, Homo sapiens
acccaccuggagauccaugg

SEQ ID NO: 4116 - RNA, 22 nt, Homo sapiens
cuuaugcaagauucccuucuac

SEQ ID NO: 4117 - RNA, 22 nt, Homo sapiens
guagaagggaaucuugcauaag

SEQ ID NO: 4118 - RNA, 22 nt, Homo sapiens
aguggggaacccuuccaugagg

SEQ ID NO: 4119 - RNA, 22 nt, Homo sapiens
ccucauggaaggguuccccacu

SEQ ID NO: 4120 - RNA, 23 nt, Homo sapiens
aggaccugcgggacaagauucuu

SEQ ID NO: 4121 - RNA, 23 nt, Homo sapiens
aagaaucuugucccgcagguccu

SEQ ID NO: 4122 - RNA, 22 nt, Homo sapiens
caaaccacacugugguguuaga

SEQ ID NO: 4123 - RNA, 22 nt, Homo sapiens
ucuaacaccacagugugguuug

SEQ ID NO: 4124 - RNA, 21 nt, Homo sapiens
cagcagcacacugugguuugu

SEQ ID NO: 4125 - RNA, 21 nt, Homo sapiens
acaaaccacagugugcugcug

SEQ ID NO: 4126 - RNA, 23 nt, Homo sapiens
uuucaagccagggggcguuuuuc

SEQ ID NO: 4127 - RNA, 23 nt, Homo sapiens
gaaaaacgcccccuggcuugaaa

SEQ ID NO: 4128 - RNA, 20 nt, Homo sapiens
ucacuaccugacaauacagu

SEQ ID NO: 4129 - RNA, 20 nt, Homo sapiens
acuguauugucagguaguga

SEQ ID NO: 4130 - RNA, 21 nt, Homo sapiens
ugcuguauugucagguaguga

SEQ ID NO: 4131 - RNA, 21 nt, Homo sapiens
ucacuaccugacaauacagca

SEQ ID NO: 4132 - RNA, 22 nt, Homo sapiens
uucugccucuguccagguccuu

SEQ ID NO: 4133 - RNA, 22 nt, Homo sapiens
aaggaccuggacagaggcagaa

SEQ ID NO: 4134 - RNA, 24 nt, Homo sapiens
agggcuggacucagcggcggagcu

SEQ ID NO: 4135 - RNA, 24 nt, Homo sapiens
agcuccgccgcugaguccagcccu

SEQ ID NO: 4136 - RNA, 21 nt, Homo sapiens
ugacugccucacugaccacuu

SEQ ID NO: 4137 - RNA, 21 nt, Homo sapiens
aaguggucagugaggcaguca

SEQ ID NO: 4138 - RNA, 24 nt, Homo sapiens
aauuugguuucugaggcacuuagu

SEQ ID NO: 4139 - RNA, 24 nt, Homo sapiens
acuaagugccucagaaaccaaauu

SEQ ID NO: 4140 - RNA, 21 nt, Homo sapiens
uacuuuucuagguuguugggg

SEQ ID NO: 4141 - RNA, 21 nt, Homo sapiens
ccccaacaaccuagaaaagua

SEQ ID NO: 4142 - RNA, 23 nt, Homo sapiens
ucacaacaaccuugcaggguaga

SEQ ID NO: 4143 - RNA, 23 nt, Homo sapiens
ucuacccugcaagguuguuguga

SEQ ID NO: 4144 - RNA, 22 nt, Homo sapiens
cuuggauuuuccugggccucag

SEQ ID NO: 4145 - RNA, 22 nt, Homo sapiens
cugaggcccaggaaaauccaag

SEQ ID NO: 4146 - RNA, 22 nt, Homo sapiens
ugaggacagggcaaauucacga

SEQ ID NO: 4147 - RNA, 22 nt, Homo sapiens
ucgugaauuugcccuguccuca

SEQ ID NO: 4148 - RNA, 22 nt, Homo sapiens
aucauaugaaccaaacucuaau

SEQ ID NO: 4149 - RNA, 22 nt, Homo sapiens
auuagaguuugguucauaugau

SEQ ID NO: 4150 - RNA, 22 nt, Homo sapiens
uagagucuggcugauaugguuu

SEQ ID NO: 4151 - RNA, 22 nt, Homo sapiens
aaaccauaucagccagacucua

SEQ ID NO: 4152 - RNA, 21 nt, Homo sapiens
ccugugcucccagggccucgc

SEQ ID NO: 4153 - RNA, 21 nt, Homo sapiens
gcgaggcccugggagcacagg

SEQ ID NO: 4154 - RNA, 22 nt, Homo sapiens
ugaggcccuuggggcacagugg

SEQ ID NO: 4155 - RNA, 22 nt, Homo sapiens
ccacugugccccaagggccuca

SEQ ID NO: 4156 - RNA, 22 nt, Homo sapiens
uccuaaaucugaaaguccaaaa

SEQ ID NO: 4157 - RNA, 22 nt, Homo sapiens
uuuuggacuuucagauuuagga

SEQ ID NO: 4158 - RNA, 24 nt, Homo sapiens
uuggacuuuuucagauuuggggau

SEQ ID NO: 4159 - RNA, 24 nt, Homo sapiens
auccccaaaucugaaaaaguccaa

SEQ ID NO: 4160 - RNA, 22 nt, Homo sapiens
augcaccugggcaaggauucug

SEQ ID NO: 4161 - RNA, 22 nt, Homo sapiens
cagaauccuugcccaggugcau

SEQ ID NO: 4162 - RNA, 23 nt, Homo sapiens
uaauccuugcuaccugggugaga

SEQ ID NO: 4163 - RNA, 23 nt, Homo sapiens
ucucacccagguagcaaggauua

SEQ ID NO: 4164 - RNA, 22 nt, Homo sapiens
uuuugugucucccauuccccag

SEQ ID NO: 4165 - RNA, 22 nt, Homo sapiens
cuggggaaugggagacacaaaa

SEQ ID NO: 4166 - RNA, 22 nt, Homo sapiens
agggggauggcagagcaaaauu

SEQ ID NO: 4167 - RNA, 22 nt, Homo sapiens
aauuuugcucugccaucccccu

SEQ ID NO: 4168 - RNA, 22 nt, Homo sapiens
gugcauggcuguauauauaaca

SEQ ID NO: 4169 - RNA, 22 nt, Homo sapiens
uguuauauauacagccaugcac

SEQ ID NO: 4170 - RNA, 21 nt, Homo sapiens
uauauauacagccaugcacuc

SEQ ID NO: 4171 - RNA, 21 nt, Homo sapiens
gagugcauggcuguauauaua

SEQ ID NO: 4172 - RNA, 22 nt, Homo sapiens
aaugcacccgggcaaggauucu

SEQ ID NO: 4173 - RNA, 22 nt, Homo sapiens
agaauccuugcccgggugcauu

SEQ ID NO: 4174 - RNA, 22 nt, Homo sapiens
aauccuuugucccugggugaga

SEQ ID NO: 4175 - RNA, 22 nt, Homo sapiens
ucucacccagggacaaaggauu

SEQ ID NO: 4176 - RNA, 22 nt, Homo sapiens
aaugcaccugggcaaggauuca

SEQ ID NO: 4177 - RNA, 22 nt, Homo sapiens
ugaauccuugcccaggugcauu

SEQ ID NO: 4178 - RNA, 21 nt, Homo sapiens
auccuugcuaucugggugcua

SEQ ID NO: 4179 - RNA, 21 nt, Homo sapiens
uagcacccagauagcaaggau

SEQ ID NO: 4180 - RNA, 22 nt, Homo sapiens
agacccuggucugcacucuauc

SEQ ID NO: 4181 - RNA, 22 nt, Homo sapiens
gauagagugcagaccagggucu

SEQ ID NO: 4182 - RNA, 21 nt, Homo sapiens
uugcagcugcgguuguaaggu

SEQ ID NO: 4183 - RNA, 21 nt, Homo sapiens
accuuacaaccgcagcugcaa

SEQ ID NO: 4184 - RNA, 22 nt, Homo sapiens
cgucaacacuugcugguuuccu

SEQ ID NO: 4185 - RNA, 22 nt, Homo sapiens
aggaaaccagcaaguguugacg

SEQ ID NO: 4186 - RNA, 22 nt, Homo sapiens
gggagccaggaaguauugaugu

SEQ ID NO: 4187 - RNA, 22 nt, Homo sapiens
acaucaauacuuccuggcuccc

SEQ ID NO: 4188 - RNA, 21 nt, Homo sapiens
uaaggcacccuucugaguaga

SEQ ID NO: 4189 - RNA, 21 nt, Homo sapiens
ucuacucagaagggugccuua

SEQ ID NO: 4190 - RNA, 22 nt, Homo sapiens
uauucaggaagguguuacuuaa

SEQ ID NO: 4191 - RNA, 22 nt, Homo sapiens
uuaaguaacaccuuccugaaua

SEQ ID NO: 4192 - RNA, 21 nt, Homo sapiens
uuuugcaccuuuuggagugaa

SEQ ID NO: 4193 - RNA, 21 nt, Homo sapiens
uucacuccaaaaggugcaaaa

SEQ ID NO: 4194 - RNA, 23 nt, Homo sapiens
ugauuguagccuuuuggaguaga

SEQ ID NO: 4195 - RNA, 23 nt, Homo sapiens
ucuacuccaaaaggcuacaauca

SEQ ID NO: 4196 - RNA, 23 nt, Homo sapiens
ggguuuguagcuuugcuggcaug

SEQ ID NO: 4197 - RNA, 23 nt, Homo sapiens
caugccagcaaagcuacaaaccc

SEQ ID NO: 4198 - RNA, 23 nt, Homo sapiens
cagggcucagggauuggauggag

SEQ ID NO: 4199 - RNA, 23 nt, Homo sapiens
cuccauccaaucccugagcccug

SEQ ID NO: 4200 - RNA, 23 nt, Homo sapiens
augcuacucggaaaucccacuga

SEQ ID NO: 4201 - RNA, 23 nt, Homo sapiens
ucagugggauuuccgaguagcau

SEQ ID NO: 4202 - RNA, 21 nt, Homo sapiens
gugggauuucugaguagcauc

SEQ ID NO: 4203 - RNA, 21 nt, Homo sapiens
gaugcuacucagaaaucccac

SEQ ID NO: 4204 - RNA, 23 nt, Homo sapiens
ccggggcagauugguguagggug

SEQ ID NO: 4205 - RNA, 23 nt, Homo sapiens
cacccuacaccaaucugccccgg

SEQ ID NO: 4206 - RNA, 23 nt, Homo sapiens
acggagacgacaagacugugcug

SEQ ID NO: 4207 - RNA, 23 nt, Homo sapiens
cagcacagucuugucgucuccgu

SEQ ID NO: 4208 - RNA, 22 nt, Homo sapiens
aauccacgcugagcuuggcauc

SEQ ID NO: 4209 - RNA, 22 nt, Homo sapiens
gaugccaagcucagcguggauu

SEQ ID NO: 4210 - RNA, 23 nt, Homo sapiens
aggaaaugaggcuggcuaggagc

SEQ ID NO: 4211 - RNA, 23 nt, Homo sapiens
gcuccuagccagccucauuuccu

SEQ ID NO: 4212 - RNA, 22 nt, Homo sapiens
ugauugguacgucuguggguag

SEQ ID NO: 4213 - RNA, 22 nt, Homo sapiens
cuacccacagacguaccaauca

SEQ ID NO: 4214 - RNA, 22 nt, Homo sapiens
aaucagugaaugccuugaaccu

SEQ ID NO: 4215 - RNA, 22 nt, Homo sapiens
agguucaaggcauucacugauu

SEQ ID NO: 4216 - RNA, 21 nt, Homo sapiens
uuacaggcgugaaccaccgcg

SEQ ID NO: 4217 - RNA, 21 nt, Homo sapiens
cgcggugguucacgccuguaa

SEQ ID NO: 4218 - RNA, 21 nt, Homo sapiens
uacugcagacaguggcaauca

SEQ ID NO: 4219 - RNA, 21 nt, Homo sapiens
ugauugccacugucugcagua

SEQ ID NO: 4220 - RNA, 21 nt, Homo sapiens
guuucaccauguuggucaggc

SEQ ID NO: 4221 - RNA, 21 nt, Homo sapiens
gccugaccaacauggugaaac

SEQ ID NO: 4222 - RNA, 23 nt, Homo sapiens
uaaauuucaccuuucugagaagg

SEQ ID NO: 4223 - RNA, 23 nt, Homo sapiens
ccuucucagaaaggugaaauuua

SEQ ID NO: 4224 - RNA, 22 nt, Homo sapiens
uucacaaggaggugucauuuau

SEQ ID NO: 4225 - RNA, 22 nt, Homo sapiens
auaaaugacaccuccuugugaa

SEQ ID NO: 4226 - RNA, 23 nt, Homo sapiens
uaaauuucaccuuucugagaaga

SEQ ID NO: 4227 - RNA, 23 nt, Homo sapiens
ucuucucagaaaggugaaauuua

SEQ ID NO: 4228 - RNA, 22 nt, Homo sapiens
uucucaaggaggugucguuuau

SEQ ID NO: 4229 - RNA, 22 nt, Homo sapiens
auaaacgacaccuccuugagaa

SEQ ID NO: 4230 - RNA, 21 nt, Homo sapiens
auugacacuucugugaguaga

SEQ ID NO: 4231 - RNA, 21 nt, Homo sapiens
ucuacucacagaagugucaau

SEQ ID NO: 4232 - RNA, 23 nt, Homo sapiens
uacucuggagagugacaaucaug

SEQ ID NO: 4233 - RNA, 23 nt, Homo sapiens
caugauugucacucuccagagua

SEQ ID NO: 4234 - RNA, 21 nt, Homo sapiens
auugacaccucugugagugga

SEQ ID NO: 4235 - RNA, 21 nt, Homo sapiens
uccacucacagaggugucaau

SEQ ID NO: 4236 - RNA, 22 nt, Homo sapiens
uucucaagagggaggcaaucau

SEQ ID NO: 4237 - RNA, 22 nt, Homo sapiens
augauugccucccucuugagaa

SEQ ID NO: 4238 - RNA, 22 nt, Homo sapiens
gagugccuucuuuuggagcguu

SEQ ID NO: 4239 - RNA, 22 nt, Homo sapiens
aacgcuccaaaagaaggcacuc

SEQ ID NO: 4240 - RNA, 18 nt, Homo sapiens
ugcuuccuuucagagggu

SEQ ID NO: 4241 - RNA, 18 nt, Homo sapiens
acccucugaaaggaagca

SEQ ID NO: 4242 - RNA, 22 nt, Homo sapiens
aucuggagguaagaagcacuuu

SEQ ID NO: 4243 - RNA, 22 nt, Homo sapiens
aaagugcuucuuaccuccagau

SEQ ID NO: 4244 - RNA, 22 nt, Homo sapiens
gaaagcgcuucccuuugcugga

SEQ ID NO: 4245 - RNA, 22 nt, Homo sapiens
uccagcaaagggaagcgcuuuc

SEQ ID NO: 4246 - RNA, 20 nt, Homo sapiens
cugcaaagggaagcccuuuc

SEQ ID NO: 4247 - RNA, 20 nt, Homo sapiens
gaaagggcuucccuuugcag

SEQ ID NO: 4248 - RNA, 21 nt, Homo sapiens
caaagcgcuucccuuuggagc

SEQ ID NO: 4249 - RNA, 21 nt, Homo sapiens
gcuccaaagggaagcgcuuug

SEQ ID NO: 4250 - RNA, 22 nt, Homo sapiens
cucuagagggaagcacuuucug

SEQ ID NO: 4251 - RNA, 22 nt, Homo sapiens
cagaaagugcuucccucuagag

SEQ ID NO: 4252 - RNA, 21 nt, Homo sapiens
aaagcgcuucccuucagagug

SEQ ID NO: 4253 - RNA, 21 nt, Homo sapiens
cacucugaagggaagcgcuuu

SEQ ID NO: 4254 - RNA, 22 nt, Homo sapiens
cucuagagggaagcgcuuucug

SEQ ID NO: 4255 - RNA, 22 nt, Homo sapiens
cagaaagcgcuucccucuagag

SEQ ID NO: 4256 - RNA, 22 nt, Homo sapiens
aaagugcauccuuuuagagguu

SEQ ID NO: 4257 - RNA, 22 nt, Homo sapiens
aaccucuaaaaggaugcacuuu

SEQ ID NO: 4258 - RNA, 22 nt, Homo sapiens
cucuagagggaagcgcuuucug

SEQ ID NO: 4259 - RNA, 22 nt, Homo sapiens
cagaaagcgcuucccucuagag

SEQ ID NO: 4260 - RNA, 22 nt, Homo sapiens
aaagugcaucuuuuuagaggau

SEQ ID NO: 4261 - RNA, 22 nt, Homo sapiens
auccucuaaaaagaugcacuuu

SEQ ID NO: 4262 - RNA, 22 nt, Homo sapiens
cucuagagggaagcgcuuucug

SEQ ID NO: 4263 - RNA, 22 nt, Homo sapiens
cagaaagcgcuucccucuagag

SEQ ID NO: 4264 - RNA, 21 nt, Homo sapiens
aaagugcuuccuuuuagaggg

SEQ ID NO: 4265 - RNA, 21 nt, Homo sapiens
cccucuaaaaggaagcacuuu

SEQ ID NO: 4266 - RNA, 22 nt, Homo sapiens
aaagugcuuccuuuuagagggu

SEQ ID NO: 4267 - RNA, 22 nt, Homo sapiens
acccucuaaaaggaagcacuuu

SEQ ID NO: 4268 - RNA, 22 nt, Homo sapiens
cucuagagggaagcacuuucug

SEQ ID NO: 4269 - RNA, 22 nt, Homo sapiens
cagaaagugcuucccucuagag

SEQ ID NO: 4270 - RNA, 22 nt, Homo sapiens
aaagugcuucucuuuggugggu

SEQ ID NO: 4271 - RNA, 22 nt, Homo sapiens
acccaccaaagagaagcacuuu

SEQ ID NO: 4272 - RNA, 20 nt, Homo sapiens
cuacaaagggaagcccuuuc

SEQ ID NO: 4273 - RNA, 20 nt, Homo sapiens
gaaagggcuucccuuuguag

SEQ ID NO: 4274 - RNA, 21 nt, Homo sapiens
aaagugcuuccuuuuugaggg

SEQ ID NO: 4275 - RNA, 21 nt, Homo sapiens
cccucaaaaaggaagcacuuu

SEQ ID NO: 4276 - RNA, 22 nt, Homo sapiens
aagugcuuccuuuuagaggguu

SEQ ID NO: 4277 - RNA, 22 nt, Homo sapiens
aacccucuaaaaggaagcacuu

SEQ ID NO: 4278 - RNA, 24 nt, Homo sapiens
acaaagugcuucccuuuagagugu

SEQ ID NO: 4279 - RNA, 24 nt, Homo sapiens
acacucuaaagggaagcacuuugu

SEQ ID NO: 4280 - RNA, 22 nt, Homo sapiens
aacgcacuucccuuuagagugu

SEQ ID NO: 4281 - RNA, 22 nt, Homo sapiens
acacucuaaagggaagugcguu

SEQ ID NO: 4282 - RNA, 22 nt, Homo sapiens
aaaaugguucccuuuagagugu

SEQ ID NO: 4283 - RNA, 22 nt, Homo sapiens
acacucuaaagggaaccauuuu

SEQ ID NO: 4284 - RNA, 22 nt, Homo sapiens
cucuagagggaagcgcuuucug

SEQ ID NO: 4285 - RNA, 22 nt, Homo sapiens
cagaaagcgcuucccucuagag

SEQ ID NO: 4286 - RNA, 23 nt, Homo sapiens
gaacgcgcuucccuauagagggu

SEQ ID NO: 4287 - RNA, 23 nt, Homo sapiens
acccucuauagggaagcgcguuc

SEQ ID NO: 4288 - RNA, 22 nt, Homo sapiens
cucuagagggaagcgcuuucug

SEQ ID NO: 4289 - RNA, 22 nt, Homo sapiens
cagaaagcgcuucccucuagag

SEQ ID NO: 4290 - RNA, 21 nt, Homo sapiens
gaaggcgcuucccuuuggagu

SEQ ID NO: 4291 - RNA, 21 nt, Homo sapiens
acuccaaagggaagcgccuuc

SEQ ID NO: 4292 - RNA, 20 nt, Homo sapiens
cugcaaagggaagcccuuuc

SEQ ID NO: 4293 - RNA, 20 nt, Homo sapiens
gaaagggcuucccuuugcag

SEQ ID NO: 4294 - RNA, 22 nt, Homo sapiens
ccucccacacccaaggcuugca

SEQ ID NO: 4295 - RNA, 22 nt, Homo sapiens
ugcaagccuugggugugggagg

SEQ ID NO: 4296 - RNA, 22 nt, Homo sapiens
caugccuugaguguaggaccgu

SEQ ID NO: 4297 - RNA, 22 nt, Homo sapiens
acgguccuacacucaaggcaug

SEQ ID NO: 4298 - RNA, 22 nt, Homo sapiens
aucauacaaggacaauuucuuu

SEQ ID NO: 4299 - RNA, 22 nt, Homo sapiens
aaagaaauuguccuuguaugau

SEQ ID NO: 4300 - RNA, 22 nt, Homo sapiens
ggagaaauuauccuuggugugu

SEQ ID NO: 4301 - RNA, 22 nt, Homo sapiens
acacaccaaggauaauuucucc

SEQ ID NO: 4302 - RNA, 22 nt, Homo sapiens
uggugggcacagaaucuggacu

SEQ ID NO: 4303 - RNA, 22 nt, Homo sapiens
aguccagauucugugcccacca

SEQ ID NO: 4304 - RNA, 25 nt, Homo sapiens
aaaggauucugcugucggucccacu

SEQ ID NO: 4305 - RNA, 25 nt, Homo sapiens
agugggaccgacagcagaauccuuu

SEQ ID NO: 4306 - RNA, 23 nt, Homo sapiens
ucggggaucaucaugucacgaga

SEQ ID NO: 4307 - RNA, 23 nt, Homo sapiens
ucucgugacaugaugauccccga

SEQ ID NO: 4308 - RNA, 22 nt, Homo sapiens
aaacauucgcggugcacuucuu

SEQ ID NO: 4309 - RNA, 22 nt, Homo sapiens
aagaagugcaccgcgaauguuu

SEQ ID NO: 4310 - RNA, 22 nt, Homo sapiens
auucugcauuuuuagcaaguuc

SEQ ID NO: 4311 - RNA, 22 nt, Homo sapiens
gaacuugcuaaaaaugcagaau

SEQ ID NO: 4312 - RNA, 22 nt, Homo sapiens
accugagguugugcauuucuaa

SEQ ID NO: 4313 - RNA, 22 nt, Homo sapiens
uuagaaaugcacaaccucaggu

SEQ ID NO: 4314 - RNA, 22 nt, Homo sapiens
ucagcaaacauuuauugugugc

SEQ ID NO: 4315 - RNA, 22 nt, Homo sapiens
gcacacaauaaauguuugcuga

SEQ ID NO: 4316 - RNA, 22 nt, Homo sapiens
ucaguaaauguuuauuagauga

SEQ ID NO: 4317 - RNA, 22 nt, Homo sapiens
ucaucuaauaaacauuuacuga

SEQ ID NO: 4318 - RNA, 22 nt, Homo sapiens
agcuacaguuacuuuugcacca

SEQ ID NO: 4319 - RNA, 22 nt, Homo sapiens
uggugcaaaaguaacuguagcu

SEQ ID NO: 4320 - RNA, 20 nt, Homo sapiens
uaaaaacugcaauuacuuuc

SEQ ID NO: 4321 - RNA, 20 nt, Homo sapiens
gaaaguaauugcaguuuuua

SEQ ID NO: 4322 - RNA, 23 nt, Homo sapiens
ugcaaaaguaauugcaguuuuug

SEQ ID NO: 4323 - RNA, 23 nt, Homo sapiens
caaaaacugcaauuacuuuugca

SEQ ID NO: 4324 - RNA, 22 nt, Homo sapiens
aaagaccgugacuacuuuugca

SEQ ID NO: 4325 - RNA, 22 nt, Homo sapiens
ugcaaaaguagucacggucuuu

SEQ ID NO: 4326 - RNA, 22 nt, Homo sapiens
agaaguaacuacgguuuuugca

SEQ ID NO: 4327 - RNA, 22 nt, Homo sapiens
ugcaaaaaccguaguuacuucu

SEQ ID NO: 4328 - RNA, 19 nt, Homo sapiens
aaaaaccacaauuacuuuu

SEQ ID NO: 4329 - RNA, 19 nt, Homo sapiens
aaaaguaauugugguuuuu

SEQ ID NO: 4330 - RNA, 19 nt, Homo sapiens
aaaaguaauugcggucuuu

SEQ ID NO: 4331 - RNA, 19 nt, Homo sapiens
aaagaccgcaauuacuuuu

SEQ ID NO: 4332 - RNA, 22 nt, Homo sapiens
caaaaacugcaauuacuuuugc

SEQ ID NO: 4333 - RNA, 22 nt, Homo sapiens
gcaaaaguaauugcaguuuuug

SEQ ID NO: 4334 - RNA, 22 nt, Homo sapiens
gaaaguaauugcuguuuuugcc

SEQ ID NO: 4335 - RNA, 22 nt, Homo sapiens
ggcaaaaacagcaauuacuuuc

SEQ ID NO: 4336 - RNA, 21 nt, Homo sapiens
uaaaacugcaguuauuuuugc

SEQ ID NO: 4337 - RNA, 21 nt, Homo sapiens
gcaaaaauaacugcaguuuua

SEQ ID NO: 4338 - RNA, 21 nt, Homo sapiens
aaaaguaauugcaguuuuugc

SEQ ID NO: 4339 - RNA, 21 nt, Homo sapiens
gcaaaaacugcaauuacuuuu

SEQ ID NO: 4340 - RNA, 22 nt, Homo sapiens
uaaaacccacaauuauguuugu

SEQ ID NO: 4341 - RNA, 22 nt, Homo sapiens
acaaacauaauuguggguuuua

SEQ ID NO: 4342 - RNA, 22 nt, Homo sapiens
aaaaguaauugcggguuuugcc

SEQ ID NO: 4343 - RNA, 22 nt, Homo sapiens
ggcaaaacccgcaauuacuuuu

SEQ ID NO: 4344 - RNA, 21 nt, Homo sapiens
caaaaccgcaguaacuuuugu

SEQ ID NO: 4345 - RNA, 21 nt, Homo sapiens
acaaaaguuacugcgguuuug

SEQ ID NO: 4346 - RNA, 22 nt, Homo sapiens
aaaaguuauugcgguuuuggcu

SEQ ID NO: 4347 - RNA, 22 nt, Homo sapiens
agccaaaaccgcaauaacuuuu

SEQ ID NO: 4348 - RNA, 21 nt, Homo sapiens
uggcaguuacuuuugcaccag

SEQ ID NO: 4349 - RNA, 21 nt, Homo sapiens
cuggugcaaaaguaacugcca

SEQ ID NO: 4350 - RNA, 21 nt, Homo sapiens
aaaaguaauugcgguuuuugc

SEQ ID NO: 4351 - RNA, 21 nt, Homo sapiens
gcaaaaaccgcaauuacuuuu

SEQ ID NO: 4352 - RNA, 20 nt, Homo sapiens
aaaacugcaguuacuuuugc

SEQ ID NO: 4353 - RNA, 20 nt, Homo sapiens
gcaaaaguaacugcaguuuu

SEQ ID NO: 4354 - RNA, 18 nt, Homo sapiens
aaaaguacuugcggauuu

SEQ ID NO: 4355 - RNA, 18 nt, Homo sapiens
aaauccgcaaguacuuuu

SEQ ID NO: 4356 - RNA, 20 nt, Homo sapiens
gugcaaaagucaucacgguu

SEQ ID NO: 4357 - RNA, 20 nt, Homo sapiens
aaccgugaugacuuuugcac

SEQ ID NO: 4358 - RNA, 22 nt, Homo sapiens
gcuggugcaaaaguaauggcgg

SEQ ID NO: 4359 - RNA, 22 nt, Homo sapiens
ccgccauuacuuuugcaccagc

SEQ ID NO: 4360 - RNA, 22 nt, Homo sapiens
aaaaguaaucacuguuuuugcc

SEQ ID NO: 4361 - RNA, 22 nt, Homo sapiens
ggcaaaaacagugauuacuuuu

SEQ ID NO: 4362 - RNA, 20 nt, Homo sapiens
agugccugagggaguaagag

SEQ ID NO: 4363 - RNA, 20 nt, Homo sapiens
cucuuacucccucaggcacu

SEQ ID NO: 4364 - RNA, 22 nt, Homo sapiens
ugucuuacucccucaggcacau

SEQ ID NO: 4365 - RNA, 22 nt, Homo sapiens
augugccugagggaguaagaca

SEQ ID NO: 4366 - RNA, 23 nt, Homo sapiens
agugccugagggaguaagagccc

SEQ ID NO: 4367 - RNA, 23 nt, Homo sapiens
gggcucuuacucccucaggcacu

SEQ ID NO: 4368 - RNA, 21 nt, Homo sapiens
gcgacccacucuugguuucca

SEQ ID NO: 4369 - RNA, 21 nt, Homo sapiens
uggaaaccaagagugggucgc

SEQ ID NO: 4370 - RNA, 22 nt, Homo sapiens
uuagcuuaaggaguaccagauc

SEQ ID NO: 4371 - RNA, 22 nt, Homo sapiens
gaucugguacuccuuaagcuaa

SEQ ID NO: 4372 - RNA, 21 nt, Homo sapiens
uaugguacuccuuaagcuaac

SEQ ID NO: 4373 - RNA, 21 nt, Homo sapiens
guuagcuuaaggaguaccaua

SEQ ID NO: 4374 - RNA, 19 nt, Homo sapiens
ugagcugcuguaccaaaau

SEQ ID NO: 4375 - RNA, 19 nt, Homo sapiens
auuuugguacagcagcuca

SEQ ID NO: 4376 - RNA, 22 nt, Homo sapiens
cacauaugaagugagccagcac

SEQ ID NO: 4377 - RNA, 22 nt, Homo sapiens
gugcuggcucacuucauaugug

SEQ ID NO: 4378 - RNA, 22 nt, Homo sapiens
ugcuggcucauuucauaugugu

SEQ ID NO: 4379 - RNA, 22 nt, Homo sapiens
acacauaugaaaugagccagca

SEQ ID NO: 4380 - RNA, 22 nt, Homo sapiens
uuccaugccuccuagaaguucc

SEQ ID NO: 4381 - RNA, 22 nt, Homo sapiens
ggaacuucuaggaggcauggaa

SEQ ID NO: 4382 - RNA, 22 nt, Homo sapiens
agccuuccaggagaaauggaga

SEQ ID NO: 4383 - RNA, 22 nt, Homo sapiens
ucuccauuucuccuggaaggcu

SEQ ID NO: 4384 - RNA, 22 nt, Homo sapiens
uaaaacuuuaagugugccuagg

SEQ ID NO: 4385 - RNA, 22 nt, Homo sapiens
ccuaggcacacuuaaaguuuua

SEQ ID NO: 4386 - RNA, 22 nt, Homo sapiens
uaggcacacuuaaaguuauagc

SEQ ID NO: 4387 - RNA, 22 nt, Homo sapiens
gcuauaacuuuaagugugccua

SEQ ID NO: 4388 - RNA, 22 nt, Homo sapiens
gaauauggguauauuaguuugg

SEQ ID NO: 4389 - RNA, 22 nt, Homo sapiens
ccaaacuaauauacccauauuc

SEQ ID NO: 4390 - RNA, 22 nt, Homo sapiens
aaacuaauauacccauauucug

SEQ ID NO: 4391 - RNA, 22 nt, Homo sapiens
cagaauauggguauauuaguuu

SEQ ID NO: 4392 - RNA, 22 nt, Homo sapiens
uaguucuucccuuugcccaauu

SEQ ID NO: 4393 - RNA, 22 nt, Homo sapiens
aauugggcaaagggaagaacua

SEQ ID NO: 4394 - RNA, 22 nt, Homo sapiens
cagggaaaugggaagaacuaga

SEQ ID NO: 4395 - RNA, 22 nt, Homo sapiens
ucuaguucuucccauuucccug

SEQ ID NO: 4396 - RNA, 22 nt, Homo sapiens
cugaauagcugggacuacaggu

SEQ ID NO: 4397 - RNA, 22 nt, Homo sapiens
accuguagucccagcuauucag

SEQ ID NO: 4398 - RNA, 22 nt, Homo sapiens
ugaaguaccagcuacucgagag

SEQ ID NO: 4399 - RNA, 22 nt, Homo sapiens
cucucgaguagcugguacuuca

SEQ ID NO: 4400 - RNA, 22 nt, Homo sapiens
cagagugacaagcugguuaaag

SEQ ID NO: 4401 - RNA, 22 nt, Homo sapiens
cuuuaaccagcuugucacucug

SEQ ID NO: 4402 - RNA, 22 nt, Homo sapiens
uauccagcuuguuacuauaugc

SEQ ID NO: 4403 - RNA, 22 nt, Homo sapiens
gcauauaguaacaagcuggaua

SEQ ID NO: 4404 - RNA, 21 nt, Homo sapiens
gccccgggcagugugaucauc

SEQ ID NO: 4405 - RNA, 21 nt, Homo sapiens
gaugaucacacugcccggggc

SEQ ID NO: 4406 - RNA, 18 nt, Homo sapiens
auggucaccuccgggacu

SEQ ID NO: 4407 - RNA, 18 nt, Homo sapiens
agucccggaggugaccau

SEQ ID NO: 4408 - RNA, 19 nt, Homo sapiens
aagucccacuaaugccagc

SEQ ID NO: 4409 - RNA, 19 nt, Homo sapiens
gcuggcauuagugggacuu

SEQ ID NO: 4410 - RNA, 21 nt, Homo sapiens
acuggcauuagugggacuuuu

SEQ ID NO: 4411 - RNA, 21 nt, Homo sapiens
aaaagucccacuaaugccagu

SEQ ID NO: 4412 - RNA, 23 nt, Homo sapiens
ugcacauggcaaccuagcuccca

SEQ ID NO: 4413 - RNA, 23 nt, Homo sapiens
ugggagcuagguugccaugugca

SEQ ID NO: 4414 - RNA, 21 nt, Homo sapiens
ggcugggugcucuugugcagu

SEQ ID NO: 4415 - RNA, 21 nt, Homo sapiens
acugcacaagagcacccagcc

SEQ ID NO: 4416 - RNA, 21 nt, Homo sapiens
uaaaguaaauaugcaccaaaa

SEQ ID NO: 4417 - RNA, 21 nt, Homo sapiens
uuuuggugcauauuuacuuua

SEQ ID NO: 4418 - RNA, 21 nt, Homo sapiens
aauaaaguucauguauggcaa

SEQ ID NO: 4419 - RNA, 21 nt, Homo sapiens
uugccauacaugaacuuuauu

SEQ ID NO: 4420 - RNA, 21 nt, Homo sapiens
uugccauacauagacuuuauu

SEQ ID NO: 4421 - RNA, 21 nt, Homo sapiens
aauaaagucuauguauggcaa

SEQ ID NO: 4422 - RNA, 21 nt, Homo sapiens
auacccauagcuuagcuccca

SEQ ID NO: 4423 - RNA, 21 nt, Homo sapiens
ugggagcuaagcuauggguau

SEQ ID NO: 4424 - RNA, 21 nt, Homo sapiens
ugggagcuaagcuauggguau

SEQ ID NO: 4425 - RNA, 21 nt, Homo sapiens
auacccauagcuuagcuccca

SEQ ID NO: 4426 - RNA, 22 nt, Homo sapiens
caaaguuuaagauccuugaagu

SEQ ID NO: 4427 - RNA, 22 nt, Homo sapiens
acuucaaggaucuuaaacuuug

SEQ ID NO: 4428 - RNA, 22 nt, Homo sapiens
aucaaggaucuuaaacuuugcc

SEQ ID NO: 4429 - RNA, 22 nt, Homo sapiens
ggcaaaguuuaagauccuugau

SEQ ID NO: 4430 - RNA, 20 nt, Homo sapiens
aaaguagcuguaccauuugc

SEQ ID NO: 4431 - RNA, 20 nt, Homo sapiens
gcaaaugguacagcuacuuu

SEQ ID NO: 4432 - RNA, 19 nt, Homo sapiens
aggcacggugucagcaggc

SEQ ID NO: 4433 - RNA, 19 nt, Homo sapiens
gccugcugacaccgugccu

SEQ ID NO: 4434 - RNA, 19 nt, Homo sapiens
gggcgccugugaucccaac

SEQ ID NO: 4435 - RNA, 19 nt, Homo sapiens
guugggaucacaggcgccc

SEQ ID NO: 4436 - RNA, 23 nt, Homo sapiens
aguauguucuuccaggacagaac

SEQ ID NO: 4437 - RNA, 23 nt, Homo sapiens
guucuguccuggaagaacauacu

SEQ ID NO: 4438 - RNA, 22 nt, Homo sapiens
gagaaaugcuggacuaaucugc

SEQ ID NO: 4439 - RNA, 22 nt, Homo sapiens
gcagauuaguccagcauuucuc

SEQ ID NO: 4440 - RNA, 22 nt, Homo sapiens
agaaaggguggcaauaccucuu

SEQ ID NO: 4441 - RNA, 22 nt, Homo sapiens
aagagguauugccacccuuucu

SEQ ID NO: 4442 - RNA, 22 nt, Homo sapiens
agguauugccacccuuucuagu

SEQ ID NO: 4443 - RNA, 22 nt, Homo sapiens
acuagaaaggguggcaauaccu

SEQ ID NO: 4444 - RNA, 22 nt, Homo sapiens
guagcaccuugcaggauaaggu

SEQ ID NO: 4445 - RNA, 22 nt, Homo sapiens
accuuauccugcaaggugcuac

SEQ ID NO: 4446 - RNA, 24 nt, Homo sapiens
uacagaugcagauucucugacuuc

SEQ ID NO: 4447 - RNA, 24 nt, Homo sapiens
gaagucagagaaucugcaucugua

SEQ ID NO: 4448 - RNA, 20 nt, Homo sapiens
aacucuagccugagcaacag

SEQ ID NO: 4449 - RNA, 20 nt, Homo sapiens
cuguugcucaggcuagaguu

SEQ ID NO: 4450 - RNA, 22 nt, Homo sapiens
acagcccagcaguuaucacggg

SEQ ID NO: 4451 - RNA, 22 nt, Homo sapiens
cccgugauaacugcugggcugu

SEQ ID NO: 4452 - RNA, 21 nt, Homo sapiens
uaucguaucguauuguauugu

SEQ ID NO: 4453 - RNA, 21 nt, Homo sapiens
acaauacaauacgauacgaua

SEQ ID NO: 4454 - RNA, 22 nt, Homo sapiens
uuagaacguuuuagggucaaau

SEQ ID NO: 4455 - RNA, 22 nt, Homo sapiens
auuugacccuaaaacguucuaa

SEQ ID NO: 4456 - RNA, 22 nt, Homo sapiens
uaacaaacaccuguaaaacagc

SEQ ID NO: 4457 - RNA, 22 nt, Homo sapiens
gcuguuuuacagguguuuguua

SEQ ID NO: 4458 - RNA, 22 nt, Homo sapiens
agcauacaccuguaguccuaga

SEQ ID NO: 4459 - RNA, 22 nt, Homo sapiens
ucuaggacuacagguguaugcu

SEQ ID NO: 4460 - RNA, 21 nt, Homo sapiens
aguuaaugaauccuggaaagu

SEQ ID NO: 4461 - RNA, 21 nt, Homo sapiens
acuuuccaggauucauuaacu

SEQ ID NO: 4462 - RNA, 21 nt, Homo sapiens
ucagcuacuaccucuauuagg

SEQ ID NO: 4463 - RNA, 21 nt, Homo sapiens
ccuaauagagguaguagcuga

SEQ ID NO: 4464 - RNA, 22 nt, Homo sapiens
uugcucugagcuccgagaaagc

SEQ ID NO: 4465 - RNA, 22 nt, Homo sapiens
gcuuucucggagcucagagcaa

SEQ ID NO: 4466 - RNA, 22 nt, Homo sapiens
caaauaauaccacagugggugu

SEQ ID NO: 4467 - RNA, 22 nt, Homo sapiens
acacccacugugguauuauuug

SEQ ID NO: 4468 - RNA, 20 nt, Homo sapiens
aauaauaucacaguaggugu

SEQ ID NO: 4469 - RNA, 20 nt, Homo sapiens
acaccuacugugauauuauu

SEQ ID NO: 4470 - RNA, 22 nt, Homo sapiens
aauaauaucacaguagguguac

SEQ ID NO: 4471 - RNA, 22 nt, Homo sapiens
guacaccuacugugauauuauu

SEQ ID NO: 4472 - RNA, 22 nt, Homo sapiens
gcaguggcucugaaaugaacuc

SEQ ID NO: 4473 - RNA, 22 nt, Homo sapiens
gaguucauuucagagccacugc

SEQ ID NO: 4474 - RNA, 21 nt, Homo sapiens
cagaucaugggacugucucag

SEQ ID NO: 4475 - RNA, 21 nt, Homo sapiens
cugagacagucccaugaucug

SEQ ID NO: 4476 - RNA, 22 nt, Homo sapiens
acuccaagaagaaucuagacag

SEQ ID NO: 4477 - RNA, 22 nt, Homo sapiens
cugucuagauucuucuuggagu

SEQ ID NO: 4478 - RNA, 22 nt, Homo sapiens
cucauuuaaguagucugaugcc

SEQ ID NO: 4479 - RNA, 22 nt, Homo sapiens
ggcaucagacuacuuaaaugag

SEQ ID NO: 4480 - RNA, 22 nt, Homo sapiens
ucaaguaguuucaugauaaagg

SEQ ID NO: 4481 - RNA, 22 nt, Homo sapiens
ccuuuaucaugaaacuacuuga

SEQ ID NO: 4482 - RNA, 22 nt, Homo sapiens
ugggggagugcagugauugugg

SEQ ID NO: 4483 - RNA, 22 nt, Homo sapiens
ccacaaucacugcacuccccca

SEQ ID NO: 4484 - RNA, 22 nt, Homo sapiens
uccugucuuuccuuguuggagc

SEQ ID NO: 4485 - RNA, 22 nt, Homo sapiens
gcuccaacaaggaaagacagga

SEQ ID NO: 4486 - RNA, 22 nt, Homo sapiens
uaaugcauuaaauuauugaagg

SEQ ID NO: 4487 - RNA, 22 nt, Homo sapiens
ccuucaauaauuuaaugcauua

SEQ ID NO: 4488 - RNA, 19 nt, Homo sapiens
uuauugucacguucugauu

SEQ ID NO: 4489 - RNA, 19 nt, Homo sapiens
aaucagaacgugacaauaa

SEQ ID NO: 4490 - RNA, 22 nt, Homo sapiens
ugagucagcaacauaucccaug

SEQ ID NO: 4491 - RNA, 22 nt, Homo sapiens
caugggauauguugcugacuca

SEQ ID NO: 4492 - RNA, 18 nt, Homo sapiens
aggagaagucgggaaggu

SEQ ID NO: 4493 - RNA, 18 nt, Homo sapiens
accuucccgacuucuccu

SEQ ID NO: 4494 - RNA, 22 nt, Homo sapiens
cgaaaacagcaauuaccuuugc

SEQ ID NO: 4495 - RNA, 22 nt, Homo sapiens
gcaaagguaauugcuguuuucg

SEQ ID NO: 4496 - RNA, 22 nt, Homo sapiens
uuaggccaucaucccauuaugc

SEQ ID NO: 4497 - RNA, 22 nt, Homo sapiens
gcauaaugggaugauggccuaa

SEQ ID NO: 4498 - RNA, 23 nt, Homo sapiens
uguuucggggcucauggccugug

SEQ ID NO: 4499 - RNA, 23 nt, Homo sapiens
cacaggccaugagccccgaaaca

SEQ ID NO: 4500 - RNA, 22 nt, Homo sapiens
aaagguaauugcaguuuuuccc

SEQ ID NO: 4501 - RNA, 22 nt, Homo sapiens
gggaaaaacugcaauuaccuuu

SEQ ID NO: 4502 - RNA, 22 nt, Homo sapiens
uucuggauaacaugcugaagcu

SEQ ID NO: 4503 - RNA, 22 nt, Homo sapiens
agcuucagcauguuauccagaa

SEQ ID NO: 4504 - RNA, 22 nt, Homo sapiens
acguuugaaugcuguacaaggc

SEQ ID NO: 4505 - RNA, 22 nt, Homo sapiens
gccuuguacagcauucaaacgu

SEQ ID NO: 4506 - RNA, 20 nt, Homo sapiens
augagcgacugugccugacc

SEQ ID NO: 4507 - RNA, 20 nt, Homo sapiens
ggucaggcacagucgcucau

SEQ ID NO: 4508 - RNA, 19 nt, Homo sapiens
gagccaguuggacaggagc

SEQ ID NO: 4509 - RNA, 19 nt, Homo sapiens
gcuccuguccaacuggcuc

SEQ ID NO: 4510 - RNA, 23 nt, Homo sapiens
uucauuugguauaaaccgcgauu

SEQ ID NO: 4511 - RNA, 23 nt, Homo sapiens
aaucgcgguuuauaccaaaugaa

SEQ ID NO: 4512 - RNA, 22 nt, Homo sapiens
uugagaaugaugaaucauuagg

SEQ ID NO: 4513 - RNA, 22 nt, Homo sapiens
ccuaaugauucaucauucucaa

SEQ ID NO: 4514 - RNA, 23 nt, Homo sapiens
uuacaguuguucaaccaguuacu

SEQ ID NO: 4515 - RNA, 23 nt, Homo sapiens
aguaacugguugaacaacuguaa

SEQ ID NO: 4516 - RNA, 21 nt, Homo sapiens
caaagaggaaggucccauuac

SEQ ID NO: 4517 - RNA, 21 nt, Homo sapiens
guaaugggaccuuccucuuug

SEQ ID NO: 4518 - RNA, 22 nt, Homo sapiens
ucaguuccaggccaaccaggcu

SEQ ID NO: 4519 - RNA, 22 nt, Homo sapiens
agccugguuggccuggaacuga

SEQ ID NO: 4520 - RNA, 22 nt, Homo sapiens
uuaugguuugccugggacugag

SEQ ID NO: 4521 - RNA, 22 nt, Homo sapiens
cucagucccaggcaaaccauaa

SEQ ID NO: 4522 - RNA, 19 nt, Homo sapiens
ugggcguaucuguaugcua

SEQ ID NO: 4523 - RNA, 19 nt, Homo sapiens
uagcauacagauacgccca

SEQ ID NO: 4524 - RNA, 20 nt, Homo sapiens
agaccauggguucucauugu

SEQ ID NO: 4525 - RNA, 20 nt, Homo sapiens
acaaugagaacccauggucu

SEQ ID NO: 4526 - RNA, 22 nt, Homo sapiens
uugugucaauaugcgaugaugu

SEQ ID NO: 4527 - RNA, 22 nt, Homo sapiens
acaucaucgcauauugacacaa

SEQ ID NO: 4528 - RNA, 19 nt, Homo sapiens
ugucucugcugggguuucu

SEQ ID NO: 4529 - RNA, 19 nt, Homo sapiens
agaaaccccagcagagaca

SEQ ID NO: 4530 - RNA, 25 nt, Homo sapiens
aggcaccagccaggcauugcucagc

SEQ ID NO: 4531 - RNA, 25 nt, Homo sapiens
gcugagcaaugccuggcuggugccu

SEQ ID NO: 4532 - RNA, 21 nt, Homo sapiens
gaagugugccguggugugucu

SEQ ID NO: 4533 - RNA, 21 nt, Homo sapiens
agacacaccacggcacacuuc

SEQ ID NO: 4534 - RNA, 21 nt, Homo sapiens
aagccugcccggcuccucggg

SEQ ID NO: 4535 - RNA, 21 nt, Homo sapiens
cccgaggagccgggcaggcuu

SEQ ID NO: 4536 - RNA, 20 nt, Homo sapiens
guugugucaguuuaucaaac

SEQ ID NO: 4537 - RNA, 20 nt, Homo sapiens
guuugauaaacugacacaac

SEQ ID NO: 4538 - RNA, 22 nt, Homo sapiens
uggucuaggauuguuggaggag

SEQ ID NO: 4539 - RNA, 22 nt, Homo sapiens
cuccuccaacaauccuagacca

SEQ ID NO: 4540 - RNA, 22 nt, Homo sapiens
cacacacugcaauuacuuuugc

SEQ ID NO: 4541 - RNA, 22 nt, Homo sapiens
gcaaaaguaauugcagugugug

SEQ ID NO: 4542 - RNA, 25 nt, Homo sapiens
aggggugguguugggacagcuccgu

SEQ ID NO: 4543 - RNA, 25 nt, Homo sapiens
acggagcugucccaacaccaccccu

SEQ ID NO: 4544 - RNA, 21 nt, Homo sapiens
ugagcuaaaugugugcuggga

SEQ ID NO: 4545 - RNA, 21 nt, Homo sapiens
ucccagcacacauuuagcuca

SEQ ID NO: 4546 - RNA, 23 nt, Homo sapiens
gcgaggaccccucggggucugac

SEQ ID NO: 4547 - RNA, 23 nt, Homo sapiens
gucagaccccgagggguccucgc

SEQ ID NO: 4548 - RNA, 25 nt, Homo sapiens
gcugggcagggcuucugagcuccuu

SEQ ID NO: 4549 - RNA, 25 nt, Homo sapiens
aaggagcucagaagcccugcccagc

SEQ ID NO: 4550 - RNA, 20 nt, Homo sapiens
gggaaaaggaagggggagga

SEQ ID NO: 4551 - RNA, 20 nt, Homo sapiens
uccucccccuuccuuuuccc

SEQ ID NO: 4552 - RNA, 20 nt, Homo sapiens
gcggaaggcggagcggcgga

SEQ ID NO: 4553 - RNA, 20 nt, Homo sapiens
uccgccgcuccgccuuccgc

SEQ ID NO: 4554 - RNA, 18 nt, Homo sapiens
gugaaggcccggcggaga

SEQ ID NO: 4555 - RNA, 18 nt, Homo sapiens
ucuccgccgggccuucac

SEQ ID NO: 4556 - RNA, 19 nt, Homo sapiens
ugagggagugggugggagg

SEQ ID NO: 4557 - RNA, 19 nt, Homo sapiens
ccucccacccacucccuca

SEQ ID NO: 4558 - RNA, 19 nt, Homo sapiens
acuggaauuggagucaaaa

SEQ ID NO: 4559 - RNA, 19 nt, Homo sapiens
uuuugacuccaauuccagu

SEQ ID NO: 4560 - RNA, 19 nt, Homo sapiens
ugagggaguuggguguaua

SEQ ID NO: 4561 - RNA, 19 nt, Homo sapiens
uauacacccaacucccuca

SEQ ID NO: 4562 - RNA, 19 nt, Homo sapiens
ugagggaguggauuguaug

SEQ ID NO: 4563 - RNA, 19 nt, Homo sapiens
cauacaauccacucccuca

SEQ ID NO: 4564 - RNA, 19 nt, Homo sapiens
ggcuggucagaugggagug

SEQ ID NO: 4565 - RNA, 19 nt, Homo sapiens
cacucccaucugaccagcc

SEQ ID NO: 4566 - RNA, 19 nt, Homo sapiens
agcagggcuggggauugca

SEQ ID NO: 4567 - RNA, 19 nt, Homo sapiens
ugcaauccccagcccugcu

SEQ ID NO: 4568 - RNA, 19 nt, Homo sapiens
ugagggaggagguugggua

SEQ ID NO: 4569 - RNA, 19 nt, Homo sapiens
uacccaaccuccucccuca

SEQ ID NO: 4570 - RNA, 19 nt, Homo sapiens
ugaggugguaggauguaga

SEQ ID NO: 4571 - RNA, 19 nt, Homo sapiens
ucuacauccuaccaccuca

SEQ ID NO: 4572 - RNA, 22 nt, Homo sapiens
uccgagccugggucucccucuu

SEQ ID NO: 4573 - RNA, 22 nt, Homo sapiens
aagagggagacccaggcucgga

SEQ ID NO: 4574 - RNA, 22 nt, Homo sapiens
ggggguccccggugcucggauc

SEQ ID NO: 4575 - RNA, 22 nt, Homo sapiens
gauccgagcaccggggaccccc

SEQ ID NO: 4576 - RNA, 22 nt, Homo sapiens
agucauuggaggguuugagcag

SEQ ID NO: 4577 - RNA, 22 nt, Homo sapiens
cugcucaaacccuccaaugacu

SEQ ID NO: 4578 - RNA, 19 nt, Homo sapiens
cagcaggaggugaggggag

SEQ ID NO: 4579 - RNA, 19 nt, Homo sapiens
cuccccucaccuccugcug

SEQ ID NO: 4580 - RNA, 22 nt, Homo sapiens
acucaaaacccuucagugacuu

SEQ ID NO: 4581 - RNA, 22 nt, Homo sapiens
aagucacugaaggguuuugagu

SEQ ID NO: 4582 - RNA, 22 nt, Homo sapiens
agacuucccauuugaagguggc

SEQ ID NO: 4583 - RNA, 22 nt, Homo sapiens
gccaccuucaaaugggaagucu

SEQ ID NO: 4584 - RNA, 23 nt, Homo sapiens
aaacucuacuuguccuucugagu

SEQ ID NO: 4585 - RNA, 23 nt, Homo sapiens
acucagaaggacaaguagaguuu

SEQ ID NO: 4586 - RNA, 21 nt, Homo sapiens
ggcuagcaacagcgcuuaccu

SEQ ID NO: 4587 - RNA, 21 nt, Homo sapiens
agguaagcgcuguugcuagcc

SEQ ID NO: 4588 - RNA, 21 nt, Homo sapiens
acagucugcugagguuggagc

SEQ ID NO: 4589 - RNA, 21 nt, Homo sapiens
gcuccaaccucagcagacugu

SEQ ID NO: 4590 - RNA, 23 nt, Homo sapiens
aucccuugcaggggcuguugggu

SEQ ID NO: 4591 - RNA, 23 nt, Homo sapiens
acccaacagccccugcaagggau

SEQ ID NO: 4592 - RNA, 22 nt, Homo sapiens
gugagucucuaagaaaagagga

SEQ ID NO: 4593 - RNA, 22 nt, Homo sapiens
uccucuuuucuuagagacucac

SEQ ID NO: 4594 - RNA, 21 nt, Homo sapiens
ucuaguaagaguggcagucga

SEQ ID NO: 4595 - RNA, 21 nt, Homo sapiens
ucgacugccacucuuacuaga

SEQ ID NO: 4596 - RNA, 22 nt, Homo sapiens
augcugacauauuuacuagagg

SEQ ID NO: 4597 - RNA, 22 nt, Homo sapiens
ccucuaguaaauaugucagcau

SEQ ID NO: 4598 - RNA, 22 nt, Homo sapiens
guucucccaacguaagcccagc

SEQ ID NO: 4599 - RNA, 22 nt, Homo sapiens
gcugggcuuacguugggagaac

SEQ ID NO: 4600 - RNA, 21 nt, Homo sapiens
uggguuuacguugggagaacu

SEQ ID NO: 4601 - RNA, 21 nt, Homo sapiens
aguucucccaacguaaaccca

SEQ ID NO: 4602 - RNA, 19 nt, Homo sapiens
gugucugcuuccuguggga

SEQ ID NO: 4603 - RNA, 19 nt, Homo sapiens
ucccacaggaagcagacac

SEQ ID NO: 4604 - RNA, 23 nt, Homo sapiens
cuaauaguaucuaccacaauaaa

SEQ ID NO: 4605 - RNA, 23 nt, Homo sapiens
uuuauugugguagauacuauuag

SEQ ID NO: 4606 - RNA, 23 nt, Homo sapiens
ugugcuugcucgucccgcccgca

SEQ ID NO: 4607 - RNA, 23 nt, Homo sapiens
ugcgggcgggacgagcaagcaca

SEQ ID NO: 4608 - RNA, 25 nt, Homo sapiens
agggaucgcgggcggguggcggccu

SEQ ID NO: 4609 - RNA, 25 nt, Homo sapiens
aggccgccacccgcccgcgaucccu

SEQ ID NO: 4610 - RNA, 21 nt, Homo sapiens
augauccaggaaccugccucu

SEQ ID NO: 4611 - RNA, 21 nt, Homo sapiens
agaggcagguuccuggaucau

SEQ ID NO: 4612 - RNA, 19 nt, Homo sapiens
aguguggcuuucuuagagc

SEQ ID NO: 4613 - RNA, 19 nt, Homo sapiens
gcucuaagaaagccacacu

SEQ ID NO: 4614 - RNA, 19 nt, Homo sapiens
ucuaggcugguacugcuga

SEQ ID NO: 4615 - RNA, 19 nt, Homo sapiens
ucagcaguaccagccuaga

SEQ ID NO: 4616 - RNA, 19 nt, Homo sapiens
aagcagcugccucugaggc

SEQ ID NO: 4617 - RNA, 19 nt, Homo sapiens
gccucagaggcagcugcuu

SEQ ID NO: 4618 - RNA, 21 nt, Homo sapiens
guggcugcacucacuuccuuc

SEQ ID NO: 4619 - RNA, 21 nt, Homo sapiens
gaaggaagugagugcagccac

SEQ ID NO: 4620 - RNA, 21 nt, Homo sapiens
aggaggcagcgcucucaggac

SEQ ID NO: 4621 - RNA, 21 nt, Homo sapiens
guccugagagcgcugccuccu

SEQ ID NO: 4622 - RNA, 21 nt, Homo sapiens
aauggcgccacuaggguugug

SEQ ID NO: 4623 - RNA, 21 nt, Homo sapiens
cacaacccuaguggcgccauu

SEQ ID NO: 4624 - RNA, 25 nt, Homo sapiens
caacccuaggagagggugccauuca

SEQ ID NO: 4625 - RNA, 25 nt, Homo sapiens
ugaauggcacccucuccuaggguug

SEQ ID NO: 4626 - RNA, 22 nt, Homo sapiens
auaauacaugguuaaccucuuu

SEQ ID NO: 4627 - RNA, 22 nt, Homo sapiens
aaagagguuaaccauguauuau

SEQ ID NO: 4628 - RNA, 21 nt, Homo sapiens
aauauuauacagucaaccucu

SEQ ID NO: 4629 - RNA, 21 nt, Homo sapiens
agagguugacuguauaauauu

SEQ ID NO: 4630 - RNA, 25 nt, Homo sapiens
ggcggagggaaguagguccguuggu

SEQ ID NO: 4631 - RNA, 25 nt, Homo sapiens
accaacggaccuacuucccuccgcc

SEQ ID NO: 4632 - RNA, 24 nt, Homo sapiens
ugccugggucucuggccugcgcgu

SEQ ID NO: 4633 - RNA, 24 nt, Homo sapiens
acgcgcaggccagagacccaggca

SEQ ID NO: 4634 - RNA, 22 nt, Homo sapiens
aggcggggcgccgcgggaccgc

SEQ ID NO: 4635 - RNA, 22 nt, Homo sapiens
gcggucccgcggcgccccgccu

SEQ ID NO: 4636 - RNA, 22 nt, Homo sapiens
gguggcccggccgugccugagg

SEQ ID NO: 4637 - RNA, 22 nt, Homo sapiens
ccucaggcacggccgggccacc

SEQ ID NO: 4638 - RNA, 20 nt, Homo sapiens
accaggaggcugaggccccu

SEQ ID NO: 4639 - RNA, 20 nt, Homo sapiens
aggggccucagccuccuggu

SEQ ID NO: 4640 - RNA, 20 nt, Homo sapiens
gucccugaguguauguggug

SEQ ID NO: 4641 - RNA, 20 nt, Homo sapiens
caccacauacacucagggac

SEQ ID NO: 4642 - RNA, 21 nt, Homo sapiens
uccgguucucagggcuccacc

SEQ ID NO: 4643 - RNA, 21 nt, Homo sapiens
gguggagcccugagaaccgga

SEQ ID NO: 4644 - RNA, 23 nt, Homo sapiens
aggaagcccuggaggggcuggag

SEQ ID NO: 4645 - RNA, 23 nt, Homo sapiens
cuccagccccuccagggcuuccu

SEQ ID NO: 4646 - RNA, 20 nt, Homo sapiens
cuguaugcccucaccgcuca

SEQ ID NO: 4647 - RNA, 20 nt, Homo sapiens
ugagcggugagggcauacag

SEQ ID NO: 4648 - RNA, 23 nt, Homo sapiens
uggugcggagagggcccacagug

SEQ ID NO: 4649 - RNA, 23 nt, Homo sapiens
cacugugggcccucuccgcacca

SEQ ID NO: 4650 - RNA, 22 nt, Homo sapiens
caacuagacugugagcuucuag

SEQ ID NO: 4651 - RNA, 22 nt, Homo sapiens
cuagaagcucacagucuaguug

SEQ ID NO: 4652 - RNA, 23 nt, Homo sapiens
aaggagcuuacaaucuagcuggg

SEQ ID NO: 4653 - RNA, 23 nt, Homo sapiens
cccagcuagauuguaagcuccuu

SEQ ID NO: 4654 - RNA, 22 nt, Homo sapiens
gggacccagggagagacguaag

SEQ ID NO: 4655 - RNA, 22 nt, Homo sapiens
cuuacgucucucccuggguccc

SEQ ID NO: 4656 - RNA, 22 nt, Homo sapiens
gcagagugcaaacaauuuugac

SEQ ID NO: 4657 - RNA, 22 nt, Homo sapiens
gucaaaauuguuugcacucugc

SEQ ID NO: 4658 - RNA, 20 nt, Homo sapiens
cggcucugggucugugggga

SEQ ID NO: 4659 - RNA, 20 nt, Homo sapiens
uccccacagacccagagccg

SEQ ID NO: 4660 - RNA, 22 nt, Homo sapiens
gcagcagggugaaacugacaca

SEQ ID NO: 4661 - RNA, 22 nt, Homo sapiens
ugugucaguuucacccugcugc

SEQ ID NO: 4662 - RNA, 21 nt, Homo sapiens
uggaggagaaggaaggugaug

SEQ ID NO: 4663 - RNA, 21 nt, Homo sapiens
caucaccuuccuucuccucca

SEQ ID NO: 4664 - RNA, 23 nt, Homo sapiens
ucugcucauaccccaugguuucu

SEQ ID NO: 4665 - RNA, 23 nt, Homo sapiens
agaaaccaugggguaugagcaga

SEQ ID NO: 4666 - RNA, 23 nt, Homo sapiens
ugcaccaugguugucugagcaug

SEQ ID NO: 4667 - RNA, 23 nt, Homo sapiens
caugcucagacaaccauggugca

SEQ ID NO: 4668 - RNA, 23 nt, Homo sapiens
cugggaucuccggggucuugguu

SEQ ID NO: 4669 - RNA, 23 nt, Homo sapiens
aaccaagaccccggagaucccag

SEQ ID NO: 4670 - RNA, 22 nt, Homo sapiens
ugagaccucuggguucugagcu

SEQ ID NO: 4671 - RNA, 22 nt, Homo sapiens
agcucagaacccagaggucuca

SEQ ID NO: 4672 - RNA, 23 nt, Homo sapiens
uccaguaccacgugucagggcca

SEQ ID NO: 4673 - RNA, 23 nt, Homo sapiens
uggcccugacacgugguacugga

SEQ ID NO: 4674 - RNA, 22 nt, Homo sapiens
ggagacugaugaguucccggga

SEQ ID NO: 4675 - RNA, 22 nt, Homo sapiens
ucccgggaacucaucagucucc

SEQ ID NO: 4676 - RNA, 21 nt, Homo sapiens
gcaggaacuugugagucuccu

SEQ ID NO: 4677 - RNA, 21 nt, Homo sapiens
aggagacucacaaguuccugc

SEQ ID NO: 4678 - RNA, 22 nt, Homo sapiens
cugcccuggcccgagggaccga

SEQ ID NO: 4679 - RNA, 22 nt, Homo sapiens
ucggucccucgggccagggcag

SEQ ID NO: 4680 - RNA, 21 nt, Homo sapiens
ccuggaaacacugagguugug

SEQ ID NO: 4681 - RNA, 21 nt, Homo sapiens
cacaaccucaguguuuccagg

SEQ ID NO: 4682 - RNA, 22 nt, Homo sapiens
uauaccucaguuuuaucaggug

SEQ ID NO: 4683 - RNA, 22 nt, Homo sapiens
caccugauaaaacugagguaua

SEQ ID NO: 4684 - RNA, 22 nt, Homo sapiens
uggugguuuacaaaguaauuca

SEQ ID NO: 4685 - RNA, 22 nt, Homo sapiens
ugaauuacuuuguaaaccacca

SEQ ID NO: 4686 - RNA, 22 nt, Homo sapiens
uggauuucuuugugaaucacca

SEQ ID NO: 4687 - RNA, 22 nt, Homo sapiens
uggugauucacaaagaaaucca

SEQ ID NO: 4688 - RNA, 21 nt, Homo sapiens
uccucuucucccuccucccag

SEQ ID NO: 4689 - RNA, 21 nt, Homo sapiens
cugggaggagggagaagagga

SEQ ID NO: 4690 - RNA, 20 nt, Homo sapiens
guagaggagauggcgcaggg

SEQ ID NO: 4691 - RNA, 20 nt, Homo sapiens
cccugcgccaucuccucuac

SEQ ID NO: 4692 - RNA, 22 nt, Homo sapiens
gugaacgggcgccaucccgagg

SEQ ID NO: 4693 - RNA, 22 nt, Homo sapiens
ccucgggauggcgcccguucac

SEQ ID NO: 4694 - RNA, 22 nt, Homo sapiens
gacugacaccucuuugggugaa

SEQ ID NO: 4695 - RNA, 22 nt, Homo sapiens
uucacccaaagaggugucaguc

SEQ ID NO: 4696 - RNA, 21 nt, Homo sapiens
uacucaaaaagcugucaguca

SEQ ID NO: 4697 - RNA, 21 nt, Homo sapiens
ugacugacagcuuuuugagua

SEQ ID NO: 4698 - RNA, 21 nt, Homo sapiens
uuaauaucggacaaccauugu

SEQ ID NO: 4699 - RNA, 21 nt, Homo sapiens
acaaugguuguccgauauuaa

SEQ ID NO: 4700 - RNA, 22 nt, Homo sapiens
auccgcgcucugacucucugcc

SEQ ID NO: 4701 - RNA, 22 nt, Homo sapiens
ggcagagagucagagcgcggau

SEQ ID NO: 4702 - RNA, 20 nt, Homo sapiens
gugagucaggguggggcugg

SEQ ID NO: 4703 - RNA, 20 nt, Homo sapiens
ccagccccacccugacucac

SEQ ID NO: 4704 - RNA, 22 nt, Homo sapiens
ugcccuuaaaggugaacccagu

SEQ ID NO: 4705 - RNA, 22 nt, Homo sapiens
acuggguucaccuuuaagggca

SEQ ID NO: 4706 - RNA, 22 nt, Homo sapiens
ucuucucuguuuuggccaugug

SEQ ID NO: 4707 - RNA, 22 nt, Homo sapiens
cacauggccaaaacagagaaga

SEQ ID NO: 4708 - RNA, 22 nt, Homo sapiens
aaauuauuguacaucggaugag

SEQ ID NO: 4709 - RNA, 22 nt, Homo sapiens
cucauccgauguacaauaauuu

SEQ ID NO: 4710 - RNA, 22 nt, Homo sapiens
uucaacggguauuuauugagca

SEQ ID NO: 4711 - RNA, 22 nt, Homo sapiens
ugcucaauaaauacccguugaa

SEQ ID NO: 4712 - RNA, 22 nt, Homo sapiens
cuauacaacuuacuacuuuccc

SEQ ID NO: 4713 - RNA, 22 nt, Homo sapiens
gggaaaguaguaaguuguauag

SEQ ID NO: 4714 - RNA, 22 nt, Homo sapiens
ugagguaguaaguuguauuguu

SEQ ID NO: 4715 - RNA, 22 nt, Homo sapiens
aacaauacaacuuacuaccuca

SEQ ID NO: 4716-4733 - skipped (18 entries)

SEQ ID NO: 4734 - DNA, 3131 bp, Adeno-associated virus
gcggccgcgaattcgcccttggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagagaatgaatcggaatttcaacatttgcttcacacacggggtcagagactgctcagagtgtttccccggcgtgtcagaatctcaaccggtcgtcagaaagaggacgtatcggaaactccgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcttacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacctttcaccacgtgactggcagcgactcatcaacaacaactggggattccgacccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgtccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagctagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctataagtgtggactttgctgttaatacagaaggcgtgtactctgaaccccgccccattggcacccgttacctcacccgtaatctgtaattgcctgttaatcaataaaccggttgattcgtttcagttgaactttggtctctgcgaagggcgaattc

SEQ ID NO: 4735 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSMGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEGQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPGVFTPALFASFITQYSTGQVSVEIEWELQKENSKRWNPEIQYTSNYAKSNNVEFAVNNEGVYTEPRPIGTRYLTRNL

SEQ ID NO: 4736 - protein, 644 aa, Adeno-associated virus
  MOD_RES (434)..(434): Any amino acid
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNXRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEP

SEQ ID NO: 4737 - DNA, 1933 bp, Adeno-associated virus
caaggcctacgaccagcagctcaaagcgggtgacaatccgtacctgcggtataaccacgccgacgccgagtttcaggagtgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggttgcaggcggtggcgcaccaatggctgacaataacgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggtgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttctccccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacgccggtacctgctaatcctccagaagtgtttactcctgccaagtttgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 4738 - protein, 644 aa, Adeno-associated virus
KAYDQQLKAGDNPYLRYNHADAEFQECLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMVAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFSPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEP

SEQ ID NO: 4739 - DNA, 1933 bp, Adeno-associated virus
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagccagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacacggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggcgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctgggccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagtttgcttccttcatcacgcagtacagcaccgggcaagtcagcgttgagatcgaatgggagctgcagaaagagaacagcaagcgctggaacccagagattcagtacacctccaactttgacaaacagactggagtggactttgctgttgacagccagggtgtttactctgagcct

SEQ ID NO: 4740 - protein, 644 aa, Adeno-associated virus
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSEPVPDPQPIGEPPAGPSGLGSGTMAAGGGAPMADNNEGADGVGNASGNWHCDSTRLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLGRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEP

SEQ ID NO: 4741 - DNA, 1933 bp, Adeno-associated virus; identical to SEQ ID NO: 4739

SEQ ID NO: 4742 - protein, 644 aa, Adeno-associated virus; identical to SEQ ID NO: 4740

SEQ ID NO: 4743 - DNA, 1933 bp, Adeno-associated virus
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggctgcaggcggtggcgcaccaatggctgacaatagcgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggtgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagcttgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 4744 - protein, 644 aa, Adeno-associated virus
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMAAGGGAPMADNSEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKLASFITQYSTGQVSVEIEWELQKENSKRWNPEIQYTSNFDKQTGVDFAVDSQGVYSEP

SEQ ID NO: 4745 - DNA, 1933 bp, Adeno-associated virus
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggcgtcacaaccatcgctaataaccttaccagcacggttcaggtcttttcggacccggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagattgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 4746 - protein, 644 aa, Adeno-associated virus
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDPEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKIASFITQYSTGQVSVEIEWELQKENSKRWNPEIQYTSNFDKQTGVDFAVDSQGVYSEP

SEQ ID NO: 4747 - protein, 728 aa, Adeno-associated virus
MAADGYLPDWLEDNLSEGIREWWDLKPGAPKPKANQQKQDDGRGLVLPGYKYLRPFNGLDKGEPVNEADAAALEHDKAYDKQLEQGDNPYLKYNHADAEFQERLQEDTSFGGNLGRAVFQAKKRVLEPLGLVEEVAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFSYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYVHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVCLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4748 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTASGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFCCLEYFPSQMLRTGNNFEFSYTFEEVPFHSSYAHSQSLDRLMNPLIDQYLYYLARTQSTTGSTRELQFHQAGPNTVAEQSKNWLPGPCYRQQRLSKNIDSNNNSNFAWTGATKYHLNGRNSLTNPGVAMATNKDDEDQFLPINGVLVFGKTGAANKTTLENVLMTSEEEIKTTNPVATEEYGVVSSNLQSSTAGPRTQTVNSQGALPGMVWQNRDVYLQGPIWAEIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4749 - protein, 738 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSTTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSARQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKGNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 4750 - DNA, 3121 bp, Adeno-associated virus
gaattcgcccttcgcagagaccaaagttcaactgaaacgaatcaaccggtttattgattaacaagcaattacagattacgggtgaggtaacgggtgccgatggggcgaggctcagaataagtgccatctgtgttaacagcaaagtccacatttgtagatttgtagtagttggaagtgtattgaatctctgggttccagcgtttgctgttttctttctgcagctcccattcaatttccacgctgacctgtccggtgctgtactgcgtgatgaacgacgccagcttagcttgactgaaggtagttggaggatccgcgggaacaggtgtattcttaatcaggatctgaggaggcgggtgtttcagtccaaagccccccatcagcggcgagggatgaaagtttccgtccgtgtgaggaatcttggcccagataggaccctgcaggtacacgtcccggttctgccagaccatgccaggtaaggctccttgactgttgacggcccctacaataggagcggcgttttgctgttgcaggttatcggccaccacgccgtactgttctgtggccactgggttggtggttttaatttcttcctcactggttagcataacgctgctatagtccacgttgccttttccagctccctgtttcccaaacattaagactccgctggacggaaaaaatcgctcttcgtcgtccttgtgggttgccatagcgacaccgggatttaccagagagtctctgccattcagatgatacttggtggcaccggtccaggcaaagttgctgttgttattttgcgacagtgtcgtggagacgcgttgctgccggtagcagggcccgggtagccagtttttggcctgagccgacatgttattaggcccggcctgagaaaatagcaactgctgagttcctgcggtacctcccgtggactgagtccgagacaggtagtacaggtactggtcgatgagggggttcatcagccggtccaggctttggctgtgcgcgtagctgctgtgaaaaggcacgtcctcaaactggtagctgaactcaaagttgttgcccgttctcagcatttgagaaggaaagtactccaggcagtagaaggaggaacggcccacggcctgactgccattgttcagagtcaggtacccgtactgaggaatcatgaagacgtccgccgggaacggaggcaggcagccctggcgcgcagagccgaggacgtacgggagctggtattccgagtccgtaaagacctgaatcgtgctggtaaggttattggcgatggtcttggtgccttcattctgcgtgacctccttgacctggatgttgaagagcttgaagttgagtctcttgggccggaatccccagttgttgttgatgagtcgctgccagtcacgtggtgagaagtggcagtggaatctgttaaagtcaaaatacccccagggggtgctgtagccgaagtaggtgttgtcgttggtgcttcctcccgaagtcccgttggagatttgcttgtagaggtggttgttgtaggtggggagggcccaggttcgggtgctggtggtgatgactctgtcgcccagccatgtggaatcgcaatgccaatttcctgaggaactacccactccgtcggcgccttcgttattgtctgccattggagcgccaccgcctgcagccattgtaccagatcccagaccagaggggcctgcggggggttctccgattggttgagggtcgggcactgactctgagtcgccagtctgcccaaagttgagtctctttttcgcgggctgctggcctttcttgccgatgcccgtagtggagtctggagaacgctggggtgatggctctaccggtctcttctttccaggagccgtcttagcgccttcctcaaccagaccgagaggttcgagaacccgcttcttggcctggaagactgctcgtccgaggttgcccccaaaagacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggcttcggggctccaggtttcagcgcccaccactcgcgaatgccctcagagaggttgtcctcgagccaatctggaagataaccatcggcagccatacctgatctaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagccgtagaagggcgaattc

SEQ ID NO: 4751 - DNA, 3121 bp, Adeno-associated virus
gaattcgcccttctacggctgcgtcaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcacgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgcgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcgatgtggatttggatgactgcatctttgaacaataaatgatttaaatcaggtatggctgccgatggttatcttccagattggctcgaggacaacctctctgagggcattcgcgagtggtgggcgctgaaacctggagccccgaagcccaaagccaaccagcaaaagcaggacggcggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgactgagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagtaacgcgtctccacgacactgtcgcaaaataacaacagcaactttgtctggaccggtgccaccaagtatcatctgaatggcagagactctctggtagatcccggtgtcgctatggcaacccacaaggacgacgaagagcgattttttccgtccagcggagtcataatgtttgggaaacagggagctggaaaagacaacgtggactatagcagcgtcatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctacctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcaggaagaaaacagcaaacgctggaacccagagattcaatacacttccaactactacaaatctacaaatgtggactttgctgttaacacagatggcacttattctgagcctcgccccatcggcacccgttacctcacccgtaatctgtaattgcttgttaatcaataaaccggttgattcgtttcagttgaactttggtctctgcgaagggcgaattc

SEQ ID NO: 4752 - protein, 738 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDGVITTSTRTWALPTYNNHLYKQISNGTSGGSTNDNTYFGYSTPWGYFDFNRFHCHFSPRDWQRLINNNWGFRPKSLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNDNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 4753 - DNA, 3121 bp, Adeno-associated virus
gaattcgcccttcgcgagaccaaagttcaactgaaacgaatcaaccggtttattgattaacaagcaattacagattacgggtgaggtaacgggtgccgatggggcgaggctcagaataagtgccatctgtgttaacagcaaagtccacatttgtagatttgtagtagttggaagtgtattgaatctctgggttccagcgtttgctgttttctttctgcagctcccattcaatttccacgctgacctgtccggtgctgtactgcgtgatgaacgacgccagcttagcttgactgaaggtagttggaggatccgcgggaacaggtgtattcttaatcaggatctgaggaggcgggtgtttcagtccaaagcctcccatcagcggcgagggatgaaagtttccgtccgtgtgaggaatcttggcccagataggaccctgcaggtacacgtcccggttctgccagaccatgccaggtaaggctccttgactgttgacggcccctacaataggagcggcgttttgctgttgcaggttatcggccaccacgccgtactgttctgtggccactgggttggtggttttaatttcttcctcactggttagcataacgctgctatagtccacgttgtcttttccagctccctgtttcccaaacattaagactccgctggacggaaaaaatcgctcttcgtcgtccttgtgggttgccatagcgacaccgggatttaccagagagtctctgccattcagatgatacttggtggcaccggtccaggcaaagttgctgttgtcattttgcgacagtgtcgtggagacgcgttgctgccggtagcagggcccgggtagccagtttttggcctgagccgacatgttattaggcccggcctgagaaaatagcaactgctgagttcctgcggtacctcccgtggactgagtccgagacaggtagtacaggtactggtcgatgagggggttcatcagccggtccaggctttggctgtgcgcgtagctgctgtgaaaaggcacgtcctcaaactggtagctgaactcaaagttgttgcccgttctcagcatttgagaaggaaagtactccaggcagtagaaggaggaacggcccacggcctgactgccattgttcagagtcaggtacccgtactgaggaatcatgaagacgtccgccgggaacggaggcaggcagccctggtgcgcagagccgaggacgtacgggagctggtattccgagtccgtaaagacctgaatcgtgctggtaaggttattggcgatggtcttggtgccttcattctgcgtgacctccttgacctggatgttgaagagcttgaagttgaggctcttgggccggaatccccagttgttgttgatgagtcgctgccagtcacgtggtgagaagtggcagtggaatctgttaaagtcaaaatacccccagggggtgctgtagccgaagtaggtgttgtcgttggtgcttcctcccgaagtcccgttggagatttgcttgtagaggtggttgttgtaggtggggagggcccaggttcgggtgctggtggtgatgactccgtcgcccagccatgtggaatcgcaatgccaatttcctgaggaactacccactccgtcggcgccttcgttattgtctgccattggagcgccaccgcctgcagccattgtaccagatcccagaccagaggggcctgcggggggttctccgattggttgagggtcgggcactgactctgagtcgccagtctgcccaaagttgagtctctttttcgcgggctgctggcctttcttgccgatgcccgtagaggagtctggagaacgctggggtgatggctctaccggtctcttctttccaggagccgtcttagcgccttcctcaaccagaccgagaggttcgagaacccgcttcttggcctggaagactgctcgcccgaggttgcccccaaaagacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggcttcggggctccaggtttcagcgcccaccactcgcgaatgccctcagagaggttgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagccgtagaaagggcgaattc

SEQ ID NO: 4754 - DNA, 2211 bp, Adeno-associated virus
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtga

SEQ ID NO: 4755 - protein, 737 aa, Adeno-associated virus
MAADGYLPDWLEDNLSEGIREWWDLKPGAPKPKANQQKQDNGRGLVLPGYKYLGPFNGLDKGEPVNAADAAALEHDKAYDQQLNAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYEQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSDPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWDPEIQYTSNFEKQTGVDFAVDSQGVYSEPRPIGTRYLTRNL

SEQ ID NO: 4756 - DNA, 2211 bp, Adeno-associated virus
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 4757 - protein, 736 aa, Adeno-associated virus
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKGAVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVRGVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTGTVNHQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 4758 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGRKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4759 - protein, 728 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRRQRLSKDIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4760 - protein, 685 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLTNPLIDQYLYYLARTQSTTGSTRGLQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKYTSNYYKSTNVDFAVNTEGTYSEPRPIGTRYLTRNL

SEQ ID NO: 4761 - protein, 733 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTVSQNNNSNFAWTGATKYHLNGRDSLVNPGVAMATHKGDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRSL

SEQ ID NO: 4762 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4763 - protein, 733 aa, Adeno-associated virus
MAADGYLPDWLEDNLSEGIREWWDLRPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTVSQNNNSNFAWTGATKYHLNGRDSLVNPGVAMATHKGDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4764 - DNA, 3098 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcttccgcccagatcgatcccacccccgtgatcgtcacttccaacaccaacatgtgcgctgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgaccgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcgaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaattgcctgttaatcaataaaccggttaattcgtttcagttgaactttggtctctgcgaagggcgaattc

SEQ ID NO: 4765 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGETGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4766 - protein, 733 aa, Adeno-associated virus
MAADGHLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNSWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4767 - DNA, 2495 bp, Adeno-associated virus
gaattcgccctttctacggctgcgtcaactagaccaatgagaactttcccttcaacgattgcgtcgacaagatggtgatctggtgggaggagggcaagatgacggccaaggtcgtggagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaccagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaacagtacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaattgcctgttaatcaataaaccggttaattcgtttcagttgaactttggtctctgcgaagggcgaattc

SEQ ID NO: 4768 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNTSNFAWTGATKYHLNGRNSLTNPGVAMATNKDDEDQFFPINGVLVFGKTGAANKTTLENVLMTSEEEIKTTNPVATEQYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4769 - DNA, 2504 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcatcacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccggctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagccggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 4770 - protein, 731 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSSRDWQRLINNNWGFRPKRLNFKLFNIQVKEVTQNEGTKTIANNLTSTIQVFTDSEYRLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKPASFITQYSTGQVSVEIEWELQKENSKRWNPEIQYTSNYYKSTNVDFAVNTEGTYSEPRPIGTRYLTRNL

SEQ ID NO: 4771 - protein, 731 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFRAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNRGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMAWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4772 - protein, 738 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4773 - protein, 735 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPRKLRFKLFNIQVKEVTTDDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMDGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4774 - DNA, 3128 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcttccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctagggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggctaattcgtttcagttgaactttggtctctgcgaagggcgaattc

SEQ ID NO: 4775 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4776 - DNA, 3084 bp, Adeno-associated virus
gaattcgccctttctacggctgcatcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagttcgaactcacccgccgtctggagcacgactttggcaaggtgaccaagcaggaagtcaaagagttcttccgctgggcgcaggatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagaaaatgaatcagaatttcaacatttgcttcacgcacggggtcagagactgctcagaatgtttccccggtgcatcagaatctcaaccggtcgtcagaaaaaaaacgtatcagaaactgtgtgccattcatcatctgctggggcgggcacccgagattgcttgctcggcctgcgatctggtcaacgtggacctggacgactgtgtttctgagcaataaatgacttaaaccaggtatggctgccgatggttatcttccagattggcttgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcacctcagcgttcccccgactcctccacgggcatcggcaagaaaggccaccagcccgcgagaaagagactgaactttgggcagactggcgactcggagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccatctctacaagcaaatctccaacgggacatcgggaggaagcactaacgacaacacctactttggctacagcaccccctgggggtattttgacttcaacagattccactgccacttctcaccacgtgactggcagcgactcatcaacaataactggggattccggcccaagagactcaacttcaagctcttcaacatccaggtcaaggaggtcacgcagaatgaaggcaccaagaccatcgccaataaccttaccagcacgattcaggtgtttacggactcggaataccagctcccgtacgtccccggctctgcgcaccagggctgcctccctccgttcccggcggacgtcttcatgattcctcagtacgggtatctgaccctaaacaatggcagtcaggctgtgggccgttcctccttctactgcctggaatacttcccttctcaaatgctgaggacgggcaacaactttgaattcagctacaccttcgaggacgtgcctttccacagcagctacgcgcacagccagagcctggaccggctgatgaaccctctcatcgaccagtacctgtattacttatccagaactcagtccacaggaggaactcaaggtactcagcaattgttattttctcaagccgggcccgcaaacatgtcggctcaggccaagaactggctacctggaccgtgttaccgtcagcaacgagtttccacgacactgtcgcaaaacaacaacagcaattttgcttggaccggtgccaccaagtatcacctgaatggcagagactccctggttaatcccggcgttgccatggctacccacaaggacgacgaggagcgcttcttcccgtcaagcggagttctaatgtttggcaagcagggggctggaaaagacaatgtggactacagcagcgtgatgctcaccagcgaagaagaaattaaaactactaacccagtggctacagagcagtatggtgtggtggcagacaacctgcagcagaccaacggagctcccattgtgggaactgtcaacagccagggggccttacctggtatggtctggcaaaaccgggacgtgtacctgcagggccccatctgggccaaaattcctcacacggacggcaactttcatccttcgccgctgatgggaggctttggactgaaacacccgcctcctcagatcctggtgaaaaacactcctgttcctgcggatcctccgaccaccttcagccaggccaagctggcttcttttatcacgcagtacagcaccggacaggtcagcgtggaaatcgaatgggagctgcagaaagaaaacagcaagcgctggaacccagagattcagtatacttccaactactacaaatctacaaatgtggactttgctgtcaatactgagggtacttattcagagcctcgccccattggcactcgttatctcacccgtaatctgtaattgcttgttaatcaataaaccggt

SEQ ID NO: 4777 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGHQPARKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVPGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQTNGAPIVGTVNSQGALPGMVWQNRDVYLQGPIWAKIPHTDGNFHPSPLMGGFGLKHPPPQILVKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4778 - DNA, 3123 bp, Adeno-associated virus
gaattcgcccttggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagttcgaactcacccgccgtctggagcacgactttggcaaggtgaccaagcaggaagtcaaagagttcttccgctgggcgcaggatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgctccagatgctgtttccctgcaaaacgtgcgagagaatgaatcagaatttcaacatttgcttcacgcacggggtcagagactgctcagaatgtttccccggtgcatcagaatctcaaccggtcgtcagaaaaaaaacgtatcagaaactgtgtgccattcatcatctgctggggcgggcacccgagattgcttgctcggcctgcgatctggtcaacgtggacctggacgactgtgtttctgagcaataaatgacttaaaccaggtatggctgccgatggttatcttccagattggcttgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcacctcagcgttcccccgactcctccacgggcatcggcaagaaaggccaccagcccgcgagaaagagactgaactttgggcagactggcgactcggagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccatctctacaagcaaatctccaacgggacatcgggaggaagcactaacgacaacacctactttggctacagcaccccctgggggtattttgacttcaacagattccactgccacttctcaccacgtgactggcagcgactcatcaacaataactggggattccggcccaagagactcaacttcaagctcttcaacatccaggtcaaggaggtcacgcagaatgaaggcaccaagaccatcgccaataaccttaccagcacgattcaggtgtttacggactcggaataccagctcccgtacgtcctcggctctgcgcaccagggctgcctccctccgttcccggcggacgtcttcatgattcctcagtacgggtatctgaccctaaacaatggcagtcaggctgtgggccgttcctccttctactgcctggaatacttcccttctcaaatgctgaggacgggcaacaactttgaattcagctacaccttcgaggacgtgcctttccacagcagctacgcgcacagccagagcctggaccggctgatgaaccctctcatcgaccagtacctgtattacttatccagaactcagtccacaggaggaactcaaggtactcagcaattgttattttctcaagccgggcccgcaaacatgtcggctcaggccaagaactggctacctggaccgtgttaccgtcagcaacgagtttccacgacactgtcgcaaaacaacaacagcaattttgcttggaccggtgccaccaagtatcacctgaatggcagagactccctggttaatcccggcgttgccatggctacccacaaggacgacgaggagcgcttcttcccgtcaagcggagttctaatgtttggcaagcagggggctggaaaagacaatgtggactacagcagcgtgatgctcaccagcgaagaagaaattaaaactactaacccagtggctacagagcagtatggtgtggtggcagacaacctgcagcagaccaacggagctcccattgtgggaactgtcaacagccagggggccttacctggtatggtctggcaaaaccgggacgtgtacctgcagggccccatctgggccaaaattcctcacacggacggcaactttcatccttcgccgctgatgggaggctttggactgaaacacccgcctcctcagatcctggtgaaaaacactcctgttcctgcggatcctccgaccaccttcagccaggccaagctggcttcttttatcacgcagtacagcaccggacaggtcagcgtggaaatcgaatgggagctgcagaaagaaaacagcaagcgctggaacccagagattcagtatacttccaactactacaaatctacaaatgtggactttgctgtcaatactgagggtacttattcagagcctcgccccattggcactcgttatctcacccgtaatctgtaattgcttgttaatcaataaaccggttaattcgtttcagttgaactttggtctctgcgaagggcgaattc

SEQ ID NO: 4779 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGHQPARKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQTNGAPIVGTVNSQGALPGMVWQNRDVYLQGPIWAKIPHTDGNFHPSPLMGGFGLKHPPPQILVKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4780 - DNA, 3122 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcgccaccttcgagcaccagcagccgttgcaggaccggatgttcaaatttgaactcacccgccgtctggagcatgactttggcaaggtgacgaagcaggaagtcaaagagttcttccgctgggcgcaggatcacgtgaccgaggtggcgcatgagttccacgtcagaaagggtggagccaacaagagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagactggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcacggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggaaggagtttatagcgagcctcgccccattggcacccgttacctcacccgcaacctgtaattacatgttaatcaataaaccggttaattcgtttcagttgaactttggtctctgcgaagggcgaattc

SEQ ID NO: 4781 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRLVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFTVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 4782 - DNA, 3117 bp, Adeno-associated virus
gaattcgcccttggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacgaagcaggaagtcaaagagttcttccgctgggcgcaggatcacgtgaccgaggtggcgcatgagttccacgtcagaaagggtggagccaacaagagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcgggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagagcaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggaaggagtttatagcgagcctcgccccattggcacccgttacctcacccgcaacctgtaattacatgttaatcaataaaccggttaattcgtttcagttgaactttggtctctgcgaagggcgaattc

SEQ ID NO: 4783 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVRVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQSNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 4784 - DNA, 3121 bp, Adeno-associated virus
gaattcgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacgaagcaggaagtcaaagagttcttccgctgggcgcaggatcacgtgaccgaggtggcgcatgagttccacgtcagaaagggtggcgccaacaagagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcctttgggggcaacctcgggcgagcagtcttccaggccaagaagcgggttctcgaacctctcggtctggttgaggaaggcgctaagacggctcctggaaagaagagaccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggacttggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgccgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggaaggagtttatagcgagcctcgccccattggcacccgttacctcacccgcaacctgtaattacatgttaatcaataaaccggttaattcgtttcagttgaactttggtctctgcgaagggcgaattc

SEQ ID NO: 4785 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDLEYQLPYVLGSAHQGCLPPFPADVFMVPQYGYLTLNNGSQALGRSSFYCLEYFPSQMPRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 4786 - DNA, 3122 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacgaagcaggaagtcaaagggttcttccgctgggcgcaggatcacgtgaccgaggtggcgcatgagttccacgtgcgagcccaagcgggcctgcccctcagtcgcggatccatcgacgtcagaccagaaagggtggagccaacaagagacccgcccccgatgacgcggatataagcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggagggggtttatagcgagcctcgccccattggcacccgttacctcacccgcaacctgtaattacatgttaatcaataaaccggttaattcgtttcagttgaactttggtctctgcgaagggcgaattc

SEQ ID NO: 4787 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 4788 - DNA, 2370 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagttcgaactcacccgccgtctggagcacgactttggcaaggtgaccaagcaggaagtcaaagagttcttccgctgggcgcaggatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagacgctgtttccctgcaaaacgtgcgagagaatgaatcagaatttcaacatttgcttcacgcacggggtcagagactgctcagaatgtttccccggtgcatcagaatctcaaccggtcgtcagaaaaaaaacgtatcagaaactgtgtgccattcatcatctgctggggcgggcacccgagattgcttgctcggcctgcgatctggtcaacgtggacctggacgactgtgtttctgagcaataaatgacttaaaccaggtatggctgccgatggttatcttccagattggcttgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcacctcagcgttcccccgactcctccacgggcatcggcaagaaaggccaccagcccgcgagaaagagactgaactttgggcagactggcgactcggagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccatctctacaagcaaatctccaacgggacatcgggaggaagcactaacgacaacacctactttggctacagcaccccctgggggtattttgacttcaacagattccactgccacttctcaccacgtgactggcagcgactcatcaacaataactggggattccggcccaagagactcaacttcaagctcttcaacatccaggtcaaggaggtcacgcagaatgaaggcaccaagaccatcgccaataaccttaccagcacgattcaggtgtttacggactcggaataccagctcccgtacgtcctcggctctgcgcaccagggctgcctccctccgttcccggcggacgtcttcatgattcctcagtacgggtatctgaccctaaacaatggcagtcaggctgtgggccgttcctccttctactgcctggaatacttcccttctcaaatgctgaggacgggcaacaactttgaattcagctacaccttcgaggacgtgcctttccacagcagctacgcgcacagccagagcctggaccggctgatgaaccctctcatcgaccagtacctgtattacttatccagaactcagtccacaggaggaactcaaggtactcagcaattgttattttctcaagccgggcccgcaaacatgtyggctcaggccaagaactggctacctggaccgtgttaccgtcagcaacgagtttccacgacactgtcgcaaaacaacaacagcaattttgctggaccggtgccacca

SEQ ID NO: 4789 - protein, 738 aa, Adeno-associated virus; identical to SEQ ID NO: 4779

SEQ ID NO: 4790 - DNA, 2205 bp, Adeno-associated virus
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 4791 - protein, 734 aa, Adeno-associated virus
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 4792 - DNA, 3128 bp, Adeno-associated virus
gaattcgccctttctacggctgcgtcaactggaccaatgagaactttcccttcaacgattgcgtcgacaagatgttgatctggtgggaggagggcaagatgacggccaaggtcgtggagtccgccaaggccattctcggcggcagcaaagtgcgcgtggaccaaaagtgcaagccgtccgcccagatcgaccccacccccgtgatcgtcacctccaacaccaacatgtgcgccgtgattgacgggaacagcaccaccttcgagcaccagcagccgttgcgggaccggatgttcaagtttgaactcacccgccgtctggagcacgactttggcaaggtgacaaagcaggaagtcagagagttcttccgctgggcgcaggatcacgtgaccgaggtggcgcacgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaaaaagacgtatcggaaactctgtgcgattcatcatctgctggggcgggcacccgagattgcttgctcggcctgcgatctggtcaacgtggacctagatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactgtaaatcccggtgtcgctatggcaacccacaaggacgacgaagagcgattttgcctggaccggtgccaccaagtatcatctgaatggcagagactctctgttttccgtccagcggagtcttaatgtttgggaaacagggagctggaaaagacaacgtggactatagcagcgttatgctaaccagtgaggaagaaattaaaaccaccaacccagtggccacggaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggacttcgctgttaacacagatggcacttattctgagcctcgccccattggcacccgttacctcacccgtaatctgtaattgctcgttaatcaataaaccggttgattcgtttcagttgaactttggtctctgcgaagggcgaattc

SEQ ID NO: 4793 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 4794 - DNA, 3129 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaagtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagtttgaactcacccgccgtctggagcacgactttggcaaggtgacaaagcaggaagtcagagagttcttccgctgggcgcaggatcacgtgaccgaggtggcgcacgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaaaaagacgtatcggaaactctgtgcgattcatcatctgctgggggcgggcacccgagattgcttgctcggcctgcgatctggtcaacgtggacctagatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccatcggcacccgttacctcacccgtaatctgtaattgcttgttaatcaataaaccggttgattcgtttcagttgaactttggtctctgcgaagggcgaattc

SEQ ID NO: 4795 - DNA, 3128 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaagtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagtttgaactcacccgccgtctggagcacgactttggcaaggtgacaaagcaggaagtcagagagttcttccgctgggcgcaggatcacgtgaccgaggtggcgcacgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggttgtcagaaaaaagacgtatcggaaactctgtgcgattcatcatctgctggggcgggcacccgagattgcttgctcggcctgcgatctggtcaacgtggacctagatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagacccaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccattggcacccgttacctcacccgtaatctgtaattgcttgttaatcaataaaccggttgattcgtttcagttgaactttggtctctgcgaagggcgaattc

SEQ ID NO: 4796 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRPNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 4797 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4798 - protein, 720 aa, Adeno-associated virus
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYL

SEQ ID NO: 4799 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4800 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4801 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4802 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4803 - protein, 728 aa, Adeno-associated virus
MAADGYLPDWLEGNLSEGIREWWDLKPGAPKPKANQQKQDDGRGLVLPGYRYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGDNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4804 - DNA, 2211 bp, Adeno-associated virus
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 4805 - protein, 736 aa, Adeno-associated virus
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 4806 - DNA, 2460 bp, Adeno-associated virus
ggtaattcctccggaaattggcattgcgattccacatggctgggcgaccgagtcattaccaccagcacccggacttgggccctgcccacctacaacaaccacctctacaagcaaatctccagccaatcgggtgccaccaacgacaaccactacttcggctacagcaccccttgggggtattttgatttcaacagattccactgccatttctcaccacgtgactggcagcgactcatcaacaacaactggggattcatggctgccgatggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttg

SEQ ID NO: 4807 - DNA, 3123 bp, Adeno-associated virus
gaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaggcaaggttcgtgtggaccagaaatgcaagtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcggacaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgtttctgtcgtcagaaaaacgtatcagaaactttgttacattcatcatatcatgggaaaagtaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccaggccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcgcggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccagtggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccacctgacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttgtaatttcctgttaatgaataagccgatttatgcgtttcagttgaactttggtctctgcgaagggcgaattcgtttaaacct

SEQ ID NO: 4808 - protein, 735 aa, Adeno-associated virus
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPGPQPIGEPPAAPSGVGSNTMASGGGAPMADNNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSAVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPVASHKDDEEKYFPMHGNLIFGKQGTGTTNVDIESVLITDEEEIRTTNPVATEQYGQVATNHQSQNTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 4809 - DNA, 3123 bp, Adeno-associated virus
gaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaagcaaggttcgtgtggaccagaaatgcaagtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcgggcaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgtttctgtcgtcagaaaaacgtatcagaaactttgttacattcatcatatcatgggaaaagaaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcgaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacgataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcaggacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttgtaatttcctgttaatgaataaaccgatttatgcgtttcagttgaactttggtctctgcgaagggcgaattcgcggccgcta

SEQ ID NO: 4810 - protein, 735 aa, Adeno-associated virus
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGESGQQPAKKRLNFGQTGDTESVPDPQPIGEPPAAPSGVGSNTMASGGGAPMADDNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPMASHKDDEEKYFPMHGNLIFGKQGTGTTNVDIESVLITDEEEIRTTNPVATEQYGQVATNHQSQDTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 4811 - DNA, 3113 bp, Adeno-associated virus
gaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaagcaaggttcgtgtggaccagaaatgcaagtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcggacaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgttcctgtcgtcagaaaaacgtatcagaaactttgttacattcatcatatcatgggaaaagtaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaataacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcaaccaagctgggcctagctccatggctcagcaggccaaaaactggctaccgggacccagctaccgacagcagcgaatgtctaagacggctaatgacaacaacaacagtgaatttgcttggactgcagccaccaaatattacccgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacgactaatcctgtggctacagaacaatacggacaggttgccaccaaccgtcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccggaaattcagtacacctccaactacaacaagtcggtgaatgtggagtttaccgtggacgcaaacggtgtttattctgaaccccgccctattggcactcgttaccttacccggaacttgtaatttcctgttaatgaataaaccgatttatgcgtttcagttgaactttggtctctgcgaagggcgaattc

SEQ ID NO: 4812 - protein, 735 aa, Adeno-associated virus
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPDPQPIGEPPAAPSGVGSNTMASGGGAPMADNNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFNQAGPSSMAQQAKNWLPGPSYRQQRMSKTANDNNNSEFAWTAATKYYPNGRNSLVNPGPPMASHKDDEEKYFPMHGNLIFGKQGTGTTNVDIESVLITDEEEIRTTNPVATEQYGQVATNRQSQNTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 4813 - DNA, 3122 bp, Adeno-associated virus
agcggccgcgaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaagcaaggttcgtgtggaccagaaatgcaggtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcggacaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgtttctgtcgtcagaaaaacgtatcagaaactttgttacattcatcatatcatgggaaaagtaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcgcctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttgtaatttcctgttaatgaataaaccgatttatgcgtttcagttgaactttggtctctgcgaagggcgaattc

SEQ ID NO: 4814 - protein, 735 aa, Adeno-associated virus
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPDPQPIGEPPAAPSGVGSNTMASGGGAPMADNNEGADGVGNSSGNWHCDSTWMGDRVITTSTRTWALPTYNNRLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPMASHKDDEEKYFPMHGNLIFGKQGTGTTNVDIESVLITDEEEIRTTNPVATEQYGQVATNHQSQNTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 4815 - protein, 733 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLSPFPNDVFMVPQYGYCGIVTGENQNQTDRNAFYCLEYFPSQMLRTGNNFEMAYNFGKVPFHSMYAYSQSPDRLMNPLLDQYLWHLQSTTSGETLNQGNAATTFGKIRSGDFAFYRKNWLPGPCVKQQRLSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRWNPEVQFTSNYGNQSSMLWAPDTTGKYTEPRVIGSRYLTNHL

SEQ ID NO: 4816 - protein, 733 aa, Adeno-associated virus
MAADGYLPDWLEDNLSEGIREWWDLKPGAPKLKANQQKQDDGRGLVLPGYKYLGPFHGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFEMAYNFEKVPFHSMYAHSQSLDRLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEGEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRRNPEVQFTSNYGNQSSMLWAPDTTGKYTEPRVIGSRYLTNHL

SEQ ID NO: 4817 - protein, 733 aa, Adeno-associated virus
MAADGYLPDWLEDNLSEGIREWWDLKPGAPKPKANQQKQDDGRGLVLPGYEYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFETAYNFEKVPFHSMYAHSQSLDGLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPAYPATTFTAARVDSFITQYSTGQVAVQIEWEIEKERSKRWNPEVQFTSNCGNQSSMLWAPDTTGKYTEPRVIGSRYLTNHL

SEQ ID NO: 4818 - protein, 735 aa, Adeno-associated virus
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPDPQPIGEPPAAPSGVGSNTMASGGGAPMADNNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPMASHKDDEEKYFPMHGNLIFGKQGTGTTNVDIESVLITDEEEIRTTNPVATEQYGQVATNHQSQNTTASYGSVDSQGILPGMVWQDRDVYLQGPIWAKIPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 4819 - DNA, 3127 bp, Adeno-associated virus
gcggccgcgaattcgcccttcgcagagaccaaagttcaactgaaacgaatcaaccggtttattgattaacatgcaattacagattacgggtgaggtaacgagtgccaatagggcgaggctcagagtaaacaccctggctgtcaacggcaaagtccacaccagtctgcttttcaaagttggaggtgtactgaatctccgggtcccagcgcttgctgttttccttctgcagctcccactcgatttccacgctgacttgtccggtgctgtactgtgtgatgaacgaagcaaacttggcaggagtaaacacctccggaggattagcgggaacgggagtgttcttgatcaggatctgaggaggcggatgtttaagtccaaagccgcccatcaaaggagacgggtgaaagttgccatccgtgtgaggaatcttggcccagatgggaccctgcaggtacacgtcccggttctgccagaccatgccaggtaaggctccctggttgttgacaacttgtgtctgggctgcagtattagccgcttgtaagttgctgctgactatcccgtattcttccgtggctacaggattagtaggacgaatttcttcttcatttgtcattaacacattttccaatgtagttttgttagttgctccagtttttccaaaaatcaggactccgctggatgggaaaaagcggtcctcgtcgtccttgtgagttgccatggcgacgccgggattaaccaacgagtttctgccgttcaggtgatatttggtggcaccagtccaagcaaagttgctgttgttgttttgatccagcgttttggagaccctttgttgccggaagcagggtccaggtaaccaattcttggcttgttcggccatagttgaaggcccgccctggtaaaactgcagttcccgattgccagctgtgcctcctgggtcactctgtgttctggccaggtagtacaagtactggtcgatgaggggattcatcagccggtccaggctctggctgtgtgcgtagctgctgtggaaaggcacgtcctcgaagctgtagctgaactcaaagttgttgcccgttctcagcatctgagaggggaagtactccaggcagtagaaggaggaacgtcccacagactgactgccattgttgagagtcaggtagccgtactgaggaatcatgaagacgtccgccgggaacggaggcaggcagccctggtgcgcagagccgaggacgtacggcagctggtattccgagtccgagaatacctgaatcgtgctggtaaggttattagcgatggtcgtaacgccgtcattcgtcgtgacctccttgacctggatgttgaagagcttgaaccgcagcttcttgggccggaatccccagttgttgttgatgagtcgctgccagtcacgtggtgagaagtggcagtggaatctgttaaagtcaaaatacccccagggggtgctgtagccgaagtaggtgttgtcgttggtactacctgcagtttcactggagatttgctcgtagaggtggttgttgtaggtgggcagggcccaggttcgggtgctggtggtaatgactctgtcgcccagccatgtggaatcgcaatgccaatttcctgaggcattacccactccgtcggcaccttcgttattgtctgccattggtgcgccaccgcctgcagccactgtaccagatcccacactagagggcgctgctggaggttctccgagaggttgagggtcggggactgactctgagtcgccagtctgaccgaaattgagtctctttctggcgggctgctggcccttcttgccgatgcccgtggaggagtcgggggaacgctgaggtgacggctctaccggtctcttctttgcaggagccgtcttagcgccttcctcaaccagaccgagaggttcgagaacccgcttcttggcctggaagactgctcgcccgaggttgcccccaaatgacgtatcttcttgcagacgctcctgaaactcggcgtcggcgtggttataccgcaggtacgggttgtcacccgcattgagctgctggtcgtaggccttgtcgtgctcgagggccgctgcgtccgccgcgttgacgggctcccccttgtcgagtccgttgaagggtccgaggtacttgtagccaggaagcaccagaccccggccgttgtcctgcttttgctggttggctttgggtttcggggctccaggtttcaggtcccaccactcgcgaatgccctcagagaggttgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggtttagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtaatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcgatcacggcgcacatgttggtgttggagatgacgatcgcgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagccgtagaaagggcgaattc

SEQ ID NO: 4820 - DNA, 3106 bp, Adeno-associated virus
gcggccgcgaattcgcccttcgcagagaccaaagttcaactgaaacgaatcaaccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgcccatcaggggagacgggtgaaagttgccgtccgtgtgaggaattttggcccagatgggaccctgcaggcacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtctaggctctggctgtgcacatagctgctgtggaaaggcacttcctcaaaggtgtagctgaattcaaagttattgcccgttctcagcatctgagaaggaaagtactccaggcagtagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagctgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggctgctggcctttcttgccgatgcccgtggaggagtcgggggattctatgggtctcttctttccaggagccgtcttagcgacttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtctgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcactctctcgcatgtcttgcagggaaacagcatctgaagcatgcccgcgtgacgagaacatttgttttggtacctgtcggcaaagtccaccggagctccttccgcgtctgacgtcgatggattcgcgactgaggggcaggcccgcttgggctcgcttttatccgcgtcatcgggggcgggtctcttgttggccccaccctttctgacgtagaacccatgcgccacctcggtcacgtgatcctgcgcccagcggaagaaccttttgacttcctgctttgtcaccttgccaaagttatgctccagacggcgggtgggttcaaatttgaacatccggtcctgcaacggctgctggtgctcgaaggtggcgctgttcccgtcaatcacggcgcacatgttggtgttggaggtgacggtcacgggggtggggtcgatctgggcggacgacttgcacttttggtccacgcgcaccttgctgccgccgagaatggccttggcggactccacgaccttggccgtcatcttgccctcctcccaccagatcaccatcttgtcggcgcaatcgttgaagggaaagttctcattggtccagttgacgcagccgtagaaagggcgaattc

SEQ ID NO: 4821 - DNA, 3102 bp, Adeno-associated virus
gcggccgcgaattcgcccttcgcagagaccaaagttcaactgaaacgaatcaaccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgcccatcaggggagacgggtgaaagttgccgtccgtgtgaggaatttcggcccagatgggaccctgcaggtacacgtcccggttctgccagaccatgccgggcagagccccctggctgttgacagtctgtgtccggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaggaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccacggtgttgggcccagcctgatggaactgcagctcccttgtggaccccgtagtgctctgggtccgggccaggtagtacaggtactggtcgatgaggggattcatcagccggtccaggctctggctgtgcgcatagctgctgtggaaaggcacttcctcaaaggtgtagctgaattcaaagttattgcccgttctcagcatctgagaaggaaagtactccaggcagcagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagccgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggctgctggcctttcttgccgatgcccgtggaggagtcgggggattctatgggtctcttctttccggaagccgtcttagcgccttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcagggaaacagcatctgaagcatgcccgcgtgacgagaacatttgttttggtacctgtcggcaaagtccaccggagctccttccgcgtctgacgtcgatggatccgcgactgaggggcaagcccgcttgggctcgcttttatccgcgtcatcgggggcgggtctcttgttggctccaccctttctgacgtagaactcatgcgccacctcggtcacgtgatcctgcgcccagcggaagaactctttgacttcctgctttgtcaccttgccaaagtcatgctccagacggcgggtgagttcaaatttgaacatccggtcttgtaacggctgctggtgctcgaaggtggtgctgttcccgtcaatcacggcgcacatgttggtgttggaagtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagccgaagggcgaattc

SEQ ID NO: 4822 - protein, 728 aa, Adeno-associated virus
MAADGYLPDWLEDNLSEGIREWWDLKPGAPKPKANQQKQDDGRGLVLPGYRYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4823 - DNA, 2187 bp, Adeno-associated virus
atggctgccgatggttatcttccagattggctcgagggcaacctctctgagggcattcgcgagtggtgggacttgaaacctggagccccgaaacccaaagccaaccagcaaaagcaggacgacggccggggtctggtgcttcctggctacaggtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaacggccagccgcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcgataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaa

SEQ ID NO: 4824 - protein, 728 aa, Adeno-associated virus; identical to SEQ ID NO: 4803

SEQ ID NO: 4825 - DNA, 3106 bp, Adeno-associated virus
gcggccgcgaattcgcccttcgcagagaccaaagttcaactgaaacgaatcagccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgcccatcaggggagacgggtgaaagttgccgtccgtgtgaggaattttggcccagatgggaccctgcaggtacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtccaggctctggctgtgcgcatagctgctgtggaaaggcacttcctcaaaggtgtagctgaattcaaagttatcgcccgttctcagcatctgagaaggaaagtactccaggcagtagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagccgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggcggctggccgttcttgccgatgcccgtggaggagtcgggggattctatgggtctcttctttccaggagccgtcttagcgccttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacctgtagccaggaagcaccagaccccggccgtcgtcctgcttttgctggttggctttgggtttcggggctccaggtttcaagtcccaccactcgcgaatgccctcagagaggttgccctcgagccaatctggaagataaccatcggcagccatacctggtttaagtcatttattgctcagaaacacagtcatccaggtccacgttggccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcaggggaacagcatctgaagcatgcccgcgtgacgagaacatttgttttggtacctgtcggcaaagtccaccggagctccttccgcgtctgacgtcgatggatccgcgactgaggggcaggcccgcttgggctcgcttttatccgcgtcatcgggggcgggtctcttgttggctccaccctttctgacgtagaactcatacgccacctcggtcacgtgatcctgcgcccagcggaagaactctttgacttcctgctttgtcaccttgccaaagtcatgctccagacggcgggtgagttcaaatttgaacatccggtcttgtaacggctgctggtgctcgaaggtggtgctgttcccgtcaatcacggcgcacatgttggtgttggaagtgacgatcacgggggtgggatcgatctgggcggacgacttgcacttttggtccacgcgcaccttgctgccgccgagaatggccttggcggactccacgaccttggccgtcatcctgccctcctcccaccagatcaccatcttgtcgacgcaatcgttgaagggaaagttctcattggtccagttgacgcagccgtagaaagggcgaattc

SEQ ID NO: 4826 - protein, 728 aa, Adeno-associated virus
MAADGYLPDWLEDNLSEGIREWWDLKPGAPKPKANQQKQDDGRGLVLPGYRYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGDNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4827 - protein, 728 aa, Adeno-associated virus; identical to SEQ ID NO: 4822

SEQ ID NO: 4828 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4829 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 4830 - DNA, 3098 bp, Adeno-associated virus
gaattcgcccttcgcagagaccaaagttcaactgaaacgaatcaaccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaactaggcaggagtaaacacccctggaggattagcaggtaccggggtgtttttgatgagaatttgaggaggcgggtgtttgagtccaaatccgcccatcaggggagacgggtgaaagttgccgtccgtgtgaggaattttggcccagatgggaccctgcaggtacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggccctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtccaggctctggctgtgcgcatagctgctgtggaaaggcacttcctcaaaggtgtagctgaattcaaagttattgcccgttctcagcatctgagaaggaaagtactccaggcagtagaaggaggaacgtcccatagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagccgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggctgctggcctttcttgccgatgcccgtggaggagtcgggggattctatgggtctcttctttccaggagccgtcttagcgccttcctcaaccagaccgagaggttcgagaacccgcttcttggcctggaagactgctcgcccgaggttgcccccaaaagacgtatcttcttgaagacgctcctgaaactcagcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcagggaaacagcatctgaagcatgcccgcgtgacgagaacatttgttttggtacctgtcggcaaagtccaccggagctccttccgcgtctgacgtcgatggatccgcgactgaggggcaggcccgcttgggctcgcttttatccgcgtcatcgggggcgggcctcttgttggctccaccctttctgacgtagaactcatgcgccacctcggtcacgtgatcctgcgcccagcggaagaactctttgacttcctgctttgtcaccttgccaaagtcctgctccagacggcgggtgagttcaaatttgaacatccggtcttgtaacggctgctggtgctcgaaggtggtgctgttcccgtcaatcacggcgcacatgttggtgttggaagtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagccgtagaaagggcgaattc

SEQ ID NO: 4831 - protein, 729 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPMADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQGLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQPSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLPRNL

SEQ ID NO: 4832 - protein, 1458 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPTADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLEHPPPQILIKNTPVPANPPEVFTPAKFASFITQYSTGQVSVEIEWELQKENSKRWNPEIQYTSNYAKSNNVEFAVNPDGVYTEPRPIGTRYLTRNLMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIGSPDSSTGIGKKGQQPAKKKLNFGQTGDSESVPDPQPLGEPPAAPSSVGSGTMAAGGGAPMADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLLNIQVKEVTTNDGVTTIANNLTSTVQVFSDSEYQLPYVLGSAHQGCLPPFPADVFMIPQYGYLTLDNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 4833 - protein, 729 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPTADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLEHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 4834 - DNA, 3075 bp, Adeno-associated virus
tgagaactttcctttcaacgattgcgtcggacaagatggtgatctggtgggaggaggggaagatgaccgccaaggtcgtggagtcggccaaagccattcttggaggaagcaaggtgcgtgtggaccagaaatgcaagtcctcggcccagatagacccgactcccgtgatcgtcacctccaacaccaacatgtgcgccgtgattgacgggaactcaacgaccttcgagcaccagcagccgttgcaagaccggatgttcaaatttgaacttacccgccgtctggatcatgactttggaaaggtcaccaagcaggaagtgaaagactttttccggtgggcaaaggatcacgtggttgaggtggagcatgaattctacgtcaaaaagggtggagctaagaaaagacccgcccccagtgacgcagatataagtgagcccaaacgggcgcgcgagtcagttgcgcagccatcaacgtcagacgcggaagcttcgatcaactacgcggacaggtaccaaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctctgaacaataaatgatttaaatcaggtatggctgccgatggttatcctccagattggctcgaggacactctctctgaagggataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcggcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcgccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaa

SEQ ID NO: 4835 - DNA, 3142 bp, Adeno-associated virus
aaaacgacgggccagtgattgtaatacgactcactatagggcgaaattgaaattagcggccgcgaattcgcctttcgcagagaccaaagttcaactgaaacgaattaaacggtttattgattaacaagcaattacagattacgagtcaggtatctggtgccaatggggcgaggctctgaatacacaccattagtgtccacagtaaagtccacattaacagacttgttgtagttggaagtgtactgaatttcgggattccagcgtttgctgttctccttctgcagctcccactcgatctccacgctgacctgtcccgtggaatactgtgtgatgaaagaagcaaacttggcagaactgaagtttgtgggaggattggctggaacgggagtgtttttgatcatgatctgaggaggcgggtgtttgagtccaaaacctcccatcagtggagaaggatgaaagtgtccatcggtgtgaggaatcttggcccaaatgggtccctgcaggtacacgtctcgatcctgccacaccataccaggtaacgctccttggtgattgacagttccagtagttggaccagtgtttgagttttgcaaattatttgacacagtcccgtactgctccgtagccacgggattggtggccctgatttcttcttcatctgtaatcatgacattttccaaatccgcgtcgttggcatttgttccttgtttaccaaatatcagggttccatgcatggggaaaaacttttcttcgtcatccttgtgactggccatagctggtcctggattaaccaacgagtcccggccatttagatgatactttgtagctgcagtccagggaaagttgctgttgttgttgtcgtttgcctgttttgacagacgctgctgtctgtagcaaggtccaggcagccagtttttagcttgaagagacatgttggttggtccagcttggctaaacagtagccgagactgctgaagagttccactatttgtttgtgtcttgttcagataatacaggtactggtcgatcagaggattcatcagccgatccagactctggctgtgagcgtagctgctgtggaaaggcacgtcttcaaaagtgtagctgaactgaaagttgtttccagtacgcagcatctgagaaggaaagtactccaggcagtaaaaggaagagcgtcctaccgcctgactcccgttgttcagggtgaggtatccatactgtgggaccatgaagacgtccgctggaaacggcgggaggcatccttgatgcgccgagcccaggacgtacgggagctggtactccgagtcagtaaacacctgaaccgtgctggtaaggttattggcaatcgtcgtcgtaccgtcattctgcgtgacctctttgacttgaatattaaagagcttgaagttgagtcttttgggccggaatccccggttgttgttgacgagtctttgccagtcacgtggtgaaaagtggcagtggaatctgttgaagtcaaaatacccccagggggtgctgtagccaaagtagtggttgtcgttgctggctcctgattggctggagatttgcttgtagaggtggttgttgtatgtgggcagggcccaggttcgggtgctggtggtgatgactctgtcgcccagccattgggaatcgcaatgccaatttcctgaggaattacccactccatcggcaccctcgttattgtctgccattggtgcgccactgcctgtagccattgtagtagatcccagaccagagggggctgctggtggctgtccgagaggctgggggtcaggtacggagtctgcgtctccagtctgaccaaaatttaatctttttcttgcaggctgctggcccgcttttccggttcccgaggaggagtctggctccacaggagagtgctctaccggcctcttttttcccggagccgtcttaacaggctcctcaaccaggcccagaggttcaagaaccctctttttcgcctggaagactgctcgtccgaggttgcccccaaaagacgtatcttctttaaggcgctcctgaaactctgcgtcggcgtggttgtacttgaggtacgggttgtctccgctgtcgagctgccggtcgtaggccttgtcgtgctcgagggccgcggcgtctgcctcgttgaccggctcccccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgatcgaagcttccgcgtctgacgtcgatggctgcgcaactgactcgcgcgcccgtttgggctcacttatatctgcgtcactgggggcgggtcttttcttagctccaccctttttgacgtagaattcatgctccacctcaaccacgtgatcctttgcccaccggaaaaagtctttcacttcctgcttggtgacctttccaaagtcatgatccagacggcgggtaagttcaaatttgaacatccggtcttgcaacggctgctggtgctcgaaggtcgttgagttcccgtcaatcacggcgcacatgttggtgttggaggtgacgatcacgggagtcgggtctatctgggccgaggacttgcatttctggtccacacgcaccttgcttcctccaagaatggctttggccgactccacgaccttggcggtcatcttcccctcctcccaccagatcaccatcttgtcgacgcaatggtaaaaggaaagttctcattgg

SEQ ID NO: 4836 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatggcggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacggcaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgacgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 4837 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNGGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANGNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLTGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4838 - DNA, 2208 bp, Adeno-associated virus
atggctgccgatggttatcttccagattggctcgaggacactctctctgaaggaataagacagtggtggaagctcaaacctggcccaccaccaccaaagctcgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccatcagcctgcgagaaagagattgaattttggtcagactggagacgcagactccgtacctgacccccagcctctcggacagccaccagcagcccccacaagtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcacggtcccacagtatggatacctcaccctgaacaacgggagtcaggcggtaggacgctcttccttttactgcctggagtactttccttctcagatgctgcgtactggaaacaaccttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaactacagttctgccaagtttgcttctttcatcacacagtattccacgggccaggtcagcgtggagattgagtgggagctgcggaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 4839 - protein, 735 aa, Adeno-associated virus
MAADGYLPDWLEDTLSEGIRQWWKLKPGPPPPKLAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFTVPQYGYLTLNNGSQAVGRSSFYCLEYFPSQMLRTGNNLTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNYSSAKFASFITQYSTGQVSVEIEWELRKENSKRWNPEIQYTSNYNKSVNVDFTVDTNGVYSEPRPIGTRYLTRNL

SEQ ID NO: 4840 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcgtctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 4841 - protein, 735 aa, Adeno-associated virus
MAADGYLPDWLEDTLSEGIRQWWKLKPGPPPPKPAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYRLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4842 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgcccttccttttactgcctggagtactttccttctcagatgctgcgtactggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatgggaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 4843 - protein, 735 aa, Adeno-associated virus
MAADGYLPDWLEDTLSEGIRQWWKLKPGPPPPKPAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRPSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4844 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggagcctgttaaaacggctccgggaaaaaagaggccggtagagcactctcctgcggagccagactcctcctcgggaaccggaaaagcgggccagcagcctgcaagaaaaagattgaatttcggtcagactggagacgcagactccgtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgaacttgggccctgcccacctacaacaaccatctctacaagcaaatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggccagccacaaggacgatgaagaaaagttttttcctcagagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctgcagggcggcaacacacaagcagctaccgcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacagattctcatcaagaacaccccggtacctgcgaatccttcgaccaccttcagtgcggcaaagtttgcttctttcatcacacagtattccacggggcaggtcagcgtggagatcgagtgggagctgcagaaggagaacagcaaacgctggaatcccgagatccagtacacttccaactacaacaaatctgttaatgtggactttactgttgacactaatggcgtgtattcagagcctcgccccattggcaccagatacctgactcgtaatctgtaa

SEQ ID NO: 4845 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQGGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4846 - DNA, 3161 bp, Adeno-associated virus
gattgaatttagcggccgcgaattcgcccttgctgcgtcaactggaccaatgagaactttccattcaatgattgcgtcgacaagatggtgatctggtgggaggagggaaagatgaccgccaaggtcatggagtcggccaaagccattctcggaggaagcaaggtgcgcgtggaccagaaatgtaagtcctcggcccagatagacccgactcccgtgattgtcacctccaacaccaacatgtgcgccgtgattgacgggaactcaacgaccttcgagcaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggcgcgcgggtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaggactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcaaggacactctctctgaaggaataagacagtggtggaagctcaaacctggcccaccaccaccaaagcccgcagagcggcataaggacgacagcgggggtcttgtgcttcctgggtacaagtacctcggacccttcaacggactcgacaagggagagccggtcaacgaggcagacgccgcggccctcgagtacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaacaggaaaagcgggccagcagcctgcgagaaagagattgaattttggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaagttggcattgcgattccacatggatgggcgacagagtcatcaccaccagcacccgaacctgggctctgcccacctacaacaaccatctgtacaagcagatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaggaggtcacgcagaatgacggtacgacgacgattgccaataaccttaccagcacggttcaggtgtttactgactcggagtaccagctcccgtacgtccccggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgcttcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacagctgcggacaacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcagaaccaccaatcccgtggccacggagcagtatggttctgtatctaccaacctccagagcggcaacacacaagcagctactgcagatgtcaacacacaaggcgttcttccaggcatggtctggcaggacagagacgtgcacctgcaggggcctatctgggcaaagattccacacacggacggacattttcacccctctcccctcatgggcggatttggacttaaacaccctcctccacagattctcatcaagaacaccccggtacctgcaaatccttcgaccaccttcagtgcggcaaagtttgcttccttcatcacacagtattccacagggcaggtcagcgtggagatcgagtgggagctgcagaaggagaacagcaaacgctggaaccccgagatccagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaaccctgcaggactagtccctttagtgagg

SEQ ID NO: 4847 - DNA, 3162 bp, Adeno-associated virus
gaattgaatttagcggccgcgaattcgcccttcgcagagaccaaagttcaactgaaacgaattaaacggtttattgattaacaagcaattacagattacgagtcaggtatctggtgccaatggggcgaggctctgaatacacgccattagtgtccacagtaaagtccacattaacagacttgttgtagttggaagtgtactgaatttcgggattccagcgtttgctgttttccttctgcagctcccactcgatctccacgctgacctgtcccgtggagtactgtgtgatgaaggaagcaaactttgccgcactgaaggtggtcgaaggattcgcaggtaccggggtgttcttgatgagaatctgtggaggagggtgtttaagtccgaatccacccatgaggggagaggggtgaaaatgtccgtccgtgtgtggaatctttgcccagatgggcccctgaaggtacacatctctgtcctgccagaccatgcctggaagaacgccttgtgtgttgacatctgcggtagctgcttgtctgttgcctctctggaggttggtagatacagaaccgtactgctccgtagccacgggattggttgtcctgatttcctcttcgtctgtaatcatgaccttttcaatgtccacatttgttttctctgagccttgcttcccaaagatgagaaccccgctctgaggaaaaaacttttcttcattgtccttgtggcttgccatggccgggcccggattcaccagagagtctctgccattgaggtggtacttggtagctccagtccacgagtattcactgttgttgttatccgcagatgtctttgatactcgctgctggcggtaacagggtccaggaagccagttcctagactggtcccgaatgtcactcgctccggcctgagaaaactgaagccttgactgcgtggtggttccacttggagtgtttgttgtgctcaagtaatacaggtactggtcgatgagaggattcatgagacggtccagactctggctgtgagcgtagccgctgtggaaaggaacgtcctcaaaagtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctctttgacttgaatgttaaagagcttgaagttgagtctcttgggtcggaatccccagttgttgttgatgagtctttgccagtcacgtggtgaaaagtggcagtggaatctgttgaagtcaaaatacccccaaggggtgctgtagccaaagtagtgattgtcgttcgaggctcctgattggctggaaatttgtttgtagaggtggttgttgtaggtgggcagggcccaggttcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtactgagtctgcgtctccagtctgaccaaaattcaatctttttcttgcaggctgctggcccgcctttccggttcccgaggaggagtctggctccacaggagagtgctctaccggcctcttttttcctggagccgtcttgacaggttccccaaccaggcccagaggttcaagaaccctctttttcgcctggaagactgctcgtccgaggttgcccccaaaagacgtatcttctttaaggcgctcctgaaactccgcgtcggcgtggttgtacttgaggtacgggttgtctccgctgtcgagctgccggtcgtaggctttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagcaagggcgaattcgtttaaacctgcaggactagtccctttagtgaggg

SEQ ID NO: 4848 - DNA, 3164 bp, Adeno-associated virus
gcgaattgaatttagcggccgcgaattcgcccttcgcagagaccaaagttcaactgaaacgaattaaacggtttattgattaacaagcaattacaaattacgagtcaggtatctggtgccaatggggcgaggctctgaatacacgccattagtgtccacagtaaagtccacattaacagacttgttgtagttggaagtgtactgaatttcgggattccagcgtttgctgttttccttctgcagctcccactcgatctccacgctgacctgtcccgtggagtactgtgtgatgaaggaagcaaactttgccgcactgaaggtggtcgaaggattcgcaggtaccggggtgttcttgatgagaatctgtggaggagggtgtttaggtccgaatccacccatgaggggagaggggtgaaaatgtccgtccgtgtgtggaatctttgcccagatgggcccctgaaggtacacatctctgtcctgccagaccatgcctggaagaacgccttgtgtgttgacatctgcggtagctgcttgtctgttgcctctctggaggttggtagatacagaaccatactgctccgtagccacgggattggttgtcctgatttcctcttcgtctgtaatcatgaccttttcaatgtccacatttgttttctctgagccttgcttcccaaagatgagaaccccgctctgaggaaaaaacttttcttcattgtccttgtggcttgccatggccgggcccggattcaccagagagtctctgccattgaggtggtacttggtagctccagtccacgagtattcactgttgttgttatccgcagatgtctttgatactcgctgctggcggtaacagggtccaggaagccagttcctagactggtcccgaatgtcactcgctccggcctgagaaaactgaagccttgactgcgtggtggttccacttggagtgtttgttgtgctcaagtaatacaggtactggtcgatgagaggattcatgagacggtccagactctggctgtgagcgtagctgctgtggaaaggaacgtcctcaaaagtgtagctgaaggtaaagttgtttccggtacgcagcatctgagaaggaaagtactccgggcagtaaaatgaagagcgtcctactgcctgactcccgttgctcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctctttgacttgaatgttaaagagcttgaagttgagtctcttgggtcggaatccccagttgttgttgatgagtctttgccagtcacgtggtgaaaagtggcagtggaatctgttgaagtcaaaatacccccaaggggtgctgtagccaaagtagtgattgtcgttcgaggctcctgattggctggaaatttgtctgtagaggtggttgttgtaggtgggcagggcccaggttcgggtgctggtggtgatgactctgtcgcccatccatgtggaatcgcaatgccgatttcccgaggaattacccactccgtcggcgccctcgttattgtctgccattggtgcgccactgcctgtagccatcgtattagttcccagaccagagggggctgctggtggctgtccgagaggctgggggtcaggtactgagtctgcgtctccagtctgaccaaaattcaatctttttcttgcaggctgctggcccgcctttccggttcccgaggaggagtctggctccacaggagagtgctctaccggcctcttttttcccggagccgtcttaacaggttccccaaccaggcccagaggttcaagaaccctctttttcgcctggaagactgctcgtccgaggttgcccccaaaagacgtatcttctttaaggcgctcctgaaactccgcgtcggcgtggttgtacttgaggtacgggttgtctccgctgtcgagctgccggtcgtaggctttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggcccacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagcaagggcgaattcgtttaaacctgcaggactagtccctttagtgaggg

SEQ ID NO: 4849 - DNA, 3163 bp, Adeno-associated virus
accctcactaaagggactagtcctgcaggtttaaacgaattcgcccttgctgcgtcaactggagcaatgagaactttcccttcaacgactgtgtcgacaagatggtgatttggtgggaggaggggaagatgaccgccaaggtcgtggagtcggccaaagccattctcggaggaagcaaggtgcgcgtggaccagaaatgcaagtcctcggcccagatagatccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatggattctacgtcaaaaagggtggagccaagaaaagacccgcccctagtgacgcagatataagtgagcccaaacgggtgcgcgagtcagttgcgcagccatcgacgtcggacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgcgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtgctttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtaccacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaattcaattcgcc

SEQ ID NO: 4850 - protein, 735 aa, Adeno-associated virus
MAADGYLPDWLEDTLSEGIRQWWKLKPGPPPPKPAERHKDDSRGLVLPGYKYLGPFNGLYKGEPVDEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGNQPARKRLNFGQTGDADSVPDPQPLGQPPAAPSGLGSTTMATGSGAPVADNNEGADGVGNSSGNWHCDSQWLGDRVITTSTRTWALPTYNNHLYKQISSQSGASNDNHYFGYSTPWGYFDFNRFHCHFSPRDRQRLINNNWGFRPKRLNFKLFNIQVKEVTQNDGTTTIANNLTSTVQVFTDSGYQLPYVLGLAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKEDSKRWNPEIQYTSNYNKPVNVDFTVDTNGVYSEPRPIGTRYLTRNL

SEQ ID NO: 4851 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactctacaagggagagccggtcgacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggccaaaaagagggttcttgaacctctgggcttggttggggagcctgttaaaacggctccgggaaaaaagaggccggtagagcactctcctgtggagccagactcctcctcgggaaccggaaaagcgggcaaccagcctgcaagaaaaagattgaattttggtcagactggagacgcagactccgtacctgacccccagcctctcggacagccaccagcagccccctctggtctgggatctactacaatggctacaggcagtggcgcaccagtggcagacaataacgagggtgccgatggagtgggtaattcctcaggaaattggcattgcgattcccaatggctgggcgacagagtcatcaccaccagcacccgaacctgggctctgcccacctacaataaccacctctacaagcaaatctccagccaatcaggagcctcaaacgacaaccactactttggctacagcaccccctgggggtattttgacttcaacagattccactgccacttttcaccacgtgaccggcaaagactcatcaacaacaactggggattccgaccaaaaagactcaacttcaagctctttaacattcaagtcaaagaggtcacgcagaatgacggtacgacgacgattgccaataaccttaccagcacggttcaggtgtttactgactcggggtaccagctcccgtacgtcctcggcttggcgcatcaaggatgcctcccgccgttcccagcagacgtcttcatggtgccacagtatggatacctcaccctgaacaacgggagtcaggcggtaggacgctcttccttttactgcctggagtactttccttctcagatgctgcgtactggaaacaactttcagttcagctacacctttgaagacgttcctttccacagcagctacgctcacagccagagtctggatcggctgatgaatcctctgatcgaccagtacctgtattatctgaacaagacacaatcaaatagtggaactcttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggtatggtgtggcaggatcgagacgtgtacctgcagggacccatttgggccaagattcctcacaccgatggacactttcatccttctccacttatgggaggttttggactcaaacacccacctcctcagatcatgattaaaaacactcccgttccagccaatcctcccacaaacttcagttctgccaagtttgcttctttcatcacacagtattccacgggacaagtcagcgtggagatcgagtgggagctgcagaaggaggacagcaaacgctggaaccccgagatccagtacacttccaactataacaaacctgttaatgtggactttactgtggacactaatggtgtgtattcagagcctcgccccattggcaccagatacctgactcgtaatctgtaa

SEQ ID NO: 4852 - DNA, 3161 bp, Adeno-associated virus
cgaattgatttagcggccgcgaattcgcccttcgcagagaccaaagttcaactgaaacgaattaaacggtttattgattaacaagcaattacagattacgagtcaggtatctggtgccaatggggcgaggctctgaatacacaccattagtgtccacagtaaagtccacattaacagatttgttgtagttggaagtgtactggatctcgggattccagcgtttgctgttctccttctgtagctcccactcgatctccacgctgacccgccccgtggaatactgtgtgatgaaggaagcaaactttgccgcactgaaggtggtcgaaggattcgcaggtaccggggtgtttttgatgagaatctgtggaggagggtgtttaagtccgaatccgcccatgaggggagaggggtgaaaatgtccgtccgtgtgcggaatctttgcccagataggcccctgcaggtacacgtctctgtcctgccagaccatgcctggaagaacgccttgtgtgttgacatctgcagtagatgcttgtgtgttgccgctctggaggttggtagatacagaaccatactgctccgtggccacgggattggtggttctgatttcctcttcgtctgtaatcatgaccttttcaatgtccacatttgttttctctgatccttgttttccaaagatgagaaccccgctctgaggaaaaaacttttcttcatcgtccttgtggctggccattgccgggcccggattcaccagagagtctctgccattgaggtggtacttggtagctccaatccacgagtattcactgttgttgttgtccgcagatgtctttgatactcgctgctggcggtaacagggtccaggaagccagttcctagactgatcccgaatgtcactcgctccggcctgagaaaactgaagcctggactgcgtggtggttccgcttggagtgtttgttctgctcaagtaatacaggtactggtcgatgagaggattcatgagacggtccaaactctggctgtgagcgtagctgctgtggaaaggaacatcctcaaaggtgtagctgaaggtaaagttgtttccggtacgcagcatctgagaagggaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccatcattctgcgtgacctctctgacttgaatgttaaagagcttgaagttgagtctcttgggccggaatccccagttgttgttgatgagtctttgccagtcacgtggtgaaaagtggcagtggaatctgttgaagtcaaaatacccccaaggggtgctgtagccaaagtagtggttgtcgttgctggctcctgattggctggaaatctgcttgtacagatggttgttgtaggtgggcagagcccaggttcgggtgctggtggtgatgactctgtcgcccatccatgtggaatcgcaatgccaatttcccgaggaattacccactccgtcggcgccatcgttattgtctgccattggtgcgccactgcctgtagccatcgtattagttcccagaccagagggggctgctggtggctgtccgagaggctgggggtcaggtacggagtctgcgtctccagtctgaccgaaattcaatctctttcttgcaggctggttgcccgcttttccggttcccgaggaggagtctggctccacaggagagtgctctaccggcctcttttttcccggagccgtcttaacaggctcctcaaccaggcccagaggttcaagaaccctcttttttgcctggaagactgctcgtccgaggttgcccccaaaagacgtatcttctttaaggcgctcctgaaactccgcgtcggcgtggtcgtacttgaggtacgggttgtctccgctgtcgagctgccggtcgtaggccttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaggcagtgcaagcgtctggcacctttcccatgatatgatgaatgtagcaaagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgatcgaagcttccgcgtctgacgtcgatggctgcgcaactgactcgcgcgcccgtttgggctcacttatatctgcgtcactgggggcgggtcttttcttggctccaccctttttgacgtagaattcatgctccacctcaaccacgtgatcctttgcccaccggaaaaagtctttcacttcctgcttggtgaccttcccaaagtcatgatccagacggcgggttagttcaaatttgaacatccggtcttgcaacggctgctggtgttcgaaggtcgttgagttcccgtcaatcacggcgcacatgttggtgttggaggtggcgatcacgggagtcgggtctatctgggccgaggacttgcacttttggtccacgcgcaccttgcttcctccgagaatggcttcggccgattccacgaccttggcggtcatctttccctcctcccaccagatcaccatcttgtcgacacagtcgttgaagggaaagttctcattggtccagttgacgcagcaagggcgaattcgtttaaacctgcaggaactagtcccttagtgagg

SEQ ID NO: 4853 - protein, 735 aa, Adeno-associated virus
MAADGYLPDWLEDTLSEGIRQWWKLKPGPPPPKPAERHKDDSRGLVLPGYKYLGPFNGLYKGEPVNEADAAALEHDKAYDRQLDSGDNPYLKYNHAGAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGSTTMATGSGAPVADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQDSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4854 - DNA, 2208 bp, Adeno-associated virus
atggctgccgatggttatcttccagattggctcgaggacactctctctgaaggaataagacagtggtggaagctcaaacctggcccaccaccgccaaagcccgcagagcggcataaggacgacagcaggggtcttgtgcttcctgggtacaagtacctcggacccttcaacggactctacaagggagagccggtcaacgaggcagacgccgcggccctcgagcacgacaaggcctacgaccggcagctcgacagcggagacaacccgtacctcaagtacaaccacgccggcgcggagtttcaggagcgccttaaagaagatacgtcttttgggggcaacctcggacgagcagtcttccaggccaaaaagagggttcttgaacctctgggcttggttgaggagcctgttaaaacggctccgggaaaaaagaggccggtagagcactctcctgtggagccagactcctcctcgggaaccggaaaagcgggcaaccagcctgcaagaaaaagattgaattttggtcagactggagacgcagactccgtacctgacccccagcctctcggacagccaccagcagccccctctggtctgggatctactacaatggctacaggcagtggcgcaccagtggcagacaataacgagggtgccgatggagtgggtaattcctcaggaaattggcattgcgattcccaatggctgggcgacagagtcatcaccaccagcacccgaacctgggctctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgaccaaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgctgcgtactggaaacaactttcagttcagctacacctttgaagacgttcctttccacagcagctacgctcacagccagagtctggatcggctgatgaatcctctgatcgaccagtacctgtattatctgaacaagacacaatcaaatagtggaacccttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaagactcaaatactggtccaactactggaactgtcaatcaccaaggagcgttacctggtatggtgtggcaggatcgagacgtgtacctgcagggacccatttgggccaagattcctcacaccgatggacactttcatccttctccacttatgggaggttttggactcaaacacccacctcctcagatcatgattaaaaacactcccgttccagccaatcctcccacaaacttcagttctgccaagtttgcttctttcatcacacagtattccacgggacaagtcagcgtagagatcgagtgggagctgcagaaggagaacagcaaacgctggaaccccgagatccagtacacttccaactataacaaatctgttaatgtggactttactgtggacactaatggtgtgtattcagagcctcgccccattggcaccagatacctgactcgtaatctgtaa

SEQ ID NO: 4855 - protein, 738 aa, Adeno-associated virus
MAADGYLPDWLEDNLSEGIREWWDLKPGAPKPKANQQKQDDGRGLVLPGCKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYNKSVNVDFTVDTNGVYSEPRPIGTRYLTRNL

SEQ ID NO: 4856 - DNA, 2217 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctgcaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactataacaaatctgttaatgtggactttactgtggacactaatggtgtgtattcagagcctcgccccattggcaccagatacctgactcgtaatctgtaa

SEQ ID NO: 4857 - DNA, 3167 bp, Adeno-associated virus
attgaatttagcggccgcgaattcgcccttcgcagagaccaaagttcaactgaaacgaattaaacggtttattgattaacaagcaattacagattacgagtcaggtacctggtgccaatggggcgaggctctgaatacacaccattagtgtccacagtaaagtccacattaacagatttgttgtagttggaagtgtactgaatctcgggattccagcgtttgctgttctccttctgcagctcccactcgatctccacgctgacctgccccgtggagtactgtgtaatgaaggaagcaaactttgccgcactgaaggtagtcgaaggattcgcaggtaccggggtgttcttgatgagaatctgcgggggagggtgtttaagtccgaatccgcccatgaggggagaggggtgaaaatgtccgtccgtgtgtggaatctttgcccagatgggcccctgcaggtacacgtctctgtcctgccacaccatgcctggaagaacgccttgtgtgttgacatctgaggtagctgcttgtgtgttgccgctctggaggttggtagatacagaaccatactgctccgtagccacgggattggtggtcctgatttcctcttcgtctgtaatcatgaccttttcaatgtccacattagtttttcccgagtcttgttttccaaagatgagaaccccgctctgaggaaaaaacttttcttcatcgtccttgtggctggccatggccgggcccggattcaccagagagtctcttccattaaggtggtacttggtagctccagtccacgagtattcactgttgttgttatccgcagatgtctttgatactcgctgctggcggtaacagggtccaggaagccagttcctagactggtcccgaatgtcacttgctccggcctgagaaaactgaagccttgactgcgtggtggttccgcttggagtgtttgttctgctcaagtaatacaggtactggtcgatgagaggattcatgagacggtccaaactctggctgtgggcgtagctgctgtggaaaggaacgtcctcaaaggtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctccttgacttgaatgttaaagagcttgaagttgagtcttttgggccggaatccccaattgttgttgatgagtctttgccagtcacgtggcgaaaagtggcagtggaatctgttgaagtcaaaatacccccaaggggtgctgtagccaaagtagtggttgtcgtttgaggctcctgattggctggaaatctgcttgtagaggtggttgttgtaggtgggcagagcccaggtgcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtacggagtctgcgtctccagtctgaccgaaattcaatctctttcttgcaggctgctggcccgcttttccggttcccgaggaggagtctggctccgcaggagagtgctctaccggcctcttttttcccggagccgtcttaacaggttcctcaaccaggcccagaggttcaagaaccctctttttcgcctggaagactgctcgtccgaggttgcccccaaaagacgtatcttctttaagacgctcctggaactccgcgtcggcgtggttgtacttggggtacgggttgtctccgctgtcgagctgccggtcgtaggccttgtcgtgctcgagggccgcggcgtctgcctcgttgaccggctctcccttgtcgagtccgttgaagggtccaaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaagcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgattgaagcttccgcgtctgacgtcgatggctgcgcaactgactcgcgcgcccgtttgggctcacttatatctgcgtcactgggggcgggtctttttttggctccaccctttttgacgtagaattcatgctctacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcactgcgcacatgttggtgttggaggtgacaatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacgcaatcattgaaaggaaagttctcattggtccagttgacgcagccgtagaaagggcgaattcgtttaaacctgcaggactagtccctttagtgagggt

SEQ ID NO: 4858 - DNA, 3161 bp, Adeno-associated virus
aattgaatttagcggccgcgaattcgcccttcgcagagaccaaagttcaactgaaacgaattaaacggtttattgattaacaagcaattacagattacgagtcaggtatctggtgccaatggggcgaggctctgaatacacaccattagtgtccacagtaaagtccacattaacagatttgttgtagttggaagtgtactgaatctcgggattccagcgtttgctgttctccttctgcagctcccactcgatctccacgctgacctgccccgtggagtactgtgtaatgaaggaagcaaactttgccgcactgaaggtagtcgaaggattcgcaggtaccggggtgttcttgatgagaatctgcgggggagggtgtttaagtccgaatccgcccatgaggggagaggggtgaaaatgtccgtccgtgtgtggaatctttgcccagatgggcccctgcaggtacacgtctctgtcctgccacaccatgcctggaagaacgccttgtgtgttgacatctgaggtagctgcttgtgtgttgccgctctggaggttggtagatacagaaccatactgctccgtagccacgggattggtggtcctgatttcctcttcgtctgtaatcatgaccttttcaatgtccacattagtttttcccgagtcttgttttccaaagatgagaaccccgctctgaggaaaaaacttttcttcatcgtccttgtggctggccatggccgggcccggattcaccagagagtctcttccattaaggtggtacttggtagctccagtccacgagtattcactgttgttgttatccgcagatgtctttgatactcgctgctggcggtaacagggtccaggaagccagttcctagactggtcccgaatgtcacttgctccggcctgagaaaactgaagccttgactgcgtggtggttccgcttggagtgtttgttctgctcaagtaatacaggtactggtcgacgagaggattcatgagacggtccaaactctggctgtgggcgtagctgctgtggaaaggaacgtcctcaaaggtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctccttgacttgaatgttaaagagcttgaagttgagtcttttgggccgggatccccaattgttgttgatgagtctttgccagtcacgtggcgaaaagtggcagtggaatctgttgaagtcaaaatacccccaaggggtgctgtagccaaagtagtggttgtcgtttgaggctcctgattggctggaaatctgcctgtagaggtggttgttgtaggtgggcagagcccaggtgcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtacggagtctgcgtctccagtctgaccgaaattcaatctccttcttgcaggctgctggcccgcttttccggttcccgaggaggagtctggctccgcaagagagtgctctaccggcctcttttttcccggagccgtcttaacaggttcctcaaccaggcccagaggttcaagaaccctctttttcgcctggaagactgctcgtccgaggttgcccccaaaagacgtatcttctttaagacgctcctggaactccgcgtcggcgtggttgtacttgaggtacgggttgtctccgccgtcgagctgccggtcgtaggccttgtcgtgctcgagggccgcggcgtctgcctcgttgaccggctctcccttgtcgagtccgttgaagggtccaaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaagcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgattgaagcttccgcgtctgacgtcgatggctgcgcaactgactcgcgcgcccgtttgggctcacttatatctgcgtcactgggggcgggtctttttttggctccaccctttttgacgtagaattcatgctctacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcactgcgcacatgttggtgttggaggtgacaatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacgcaatcattgaaaggaaagttctcattggtccagttgacgcagcaagggcgaattcgtttaaacctgcaggactagtccctttagtgaggg

SEQ ID NO: 4859 - DNA, 3172 bp, Adeno-associated virus
gattgaatttagcggccgcgaattcgcccttgctgcgtcaactggaccaatgagaactttcccttcaacgattgcgtcgacaagatggtgatctggtgggaggagggcaagatgaccgccaaggtcgtggagtccgccaaggccattctgggtggaagcaaggtgcgcgtggaccaaaagtgcaagtcatcggcccagatcgaccccacgcccgtgatcgtcacctccaacaccaacatgtgcgccgtgatcgacgggaacagcaccaccttcgagcaccagcagcccctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcggaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccgcgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccgagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctgcgcacacagccagagctcggaccgactgatgaatcctctcatcgaccagtacctgtactacttatccagaactcggtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaattgctggttaatcaataaaccgtttgattcgtttcagttgaactttggtctctgcgaagggcgaattcgtttaaacctgcaggactagtccctttagtgagg

SEQ ID NO: 4860 - DNA, 3172 bp, Adeno-associated virus
gattgaatttagcggccgcgaattcgcccttgctgcgtcaactggaccaatgagaactttcccttcaacgattgcgtcgacaagatggtgatctggtgggaggagggcaagatgaccgccaaggtcgtggagtccgccaaggccattctgggtggaagcaaggtgcgcgtggaccaaaagtgcaagtcatcggcccagatcgaccccacgcccgtgatcgtcacctccaacaccaacatgtgcgccgtgatcggcgggaacagcaccaccttcgagcaccagcagcccctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcctccccggcgcgtcagaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcttggctacaagtacctcggacccttcaacggactcgacaagggggagcccgtcaatgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcggctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacgacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaattgctggttaatcaataaaccgtttgattcgtttcagttgaactttggtctctgcgaagggcgaattcgtttaaacctgcaggactagtccctttagtgagg

SEQ ID NO: 4861 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgaaagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggagcctgttaaaacggctccgggaaaaaagaggccggtagagcactctcctgtggagccagactcctcctcgggaaccggaaaagcgggccagcagcctgcgagaaaaagattgaattttggtcagactggagacgcagactccgtacctgacccccagcctctcggacagccaccagcagccccctctggtctgggatctactacaatggcttcaggcagtggcgcaccagtggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacagctggggattccgacccaaaagactcaacttcaagctctttaacattcaagtcaaagaggtcacgcagaatgacggtacgacgacgattgccaataaccttaccagcacggttcaagtgtttaccgactcggagtaccagctcccgtacgtcctcggctcggcgcatcaaggatgcctcccgccgttcccagcagacgtctttatggtcccacagtatggatacctcaccctgaacaacgggagtcaggcggtaggacgctcttccttttactgcctggagtactttccttctcagatgctgcgtactggaaacaactttcagttcagctacacctttgaagacgttcccttccacagcagctacgctcacagccagagtctggatcggctgctgaatcctctgatcgaccagtacctatattatctgaacaagacacaatcaaatagtggaactcttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggtatggtgtggcaggatcgagacgtgtacctgcagggacccatttgggccaagattcctcacacggacgggcactttcatccttctccactaatgggaggttttgggctcaaacacccgcctcctcagatcatgatcaaaaacactcccgttccagccaatcctcctacaaacttcagttcttccaagtttgcttctttcatcacacagtattccacggggcaggtcagcgtggagatcgagtgggagctgcagaaggagaacagcaaacgctggaatcccgaaattcagtatacttccaactacaacaaatctgttaatgtggactttactgtggacactaatggtgtgtattcagagcctcgccccattggcaccagatacccgactcgtaatctgtaa

SEQ ID NO: 4862 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLESGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMASGSGAPVADNNEGADGVGNSSGNWHCDSQWLGDRVITTSTRTWALPTYNNHLYKQISSQSGASNDNHYFGYSTPWGYFDFNRFHCHFSPRDWQRLINNSWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLLNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSSKFASFITQYSTGQVSVEIEWELQKENSKRWNPEIQYTSNYNKSVNVDFTVDTNGVYSEPRPIGTRYPTRNL

SEQ ID NO: 4863 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggagaaaagaggccggtagagcactctcctgcggagccagactcctcctcgggaaccggaaaagcgggccagcagcctgcaagaaagagattgaattttggccagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggtattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcgtgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 4864 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGEKRPVEHSPAEPDSSSGTGKAGQQPARKRLNFGQTGDADSVPDPQPLGQPPAAPSGLGTNTMASGSGAPMADNNEGADGVGNSSGNWYCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLVGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4865 - DNA, 2209 bp, Adeno-associated virus
atggctgccgatggttatcctccagattggctcgaggacactctctctgaagggataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcggcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcgccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaat

SEQ ID NO: 4866 - protein, 735 aa, Adeno-associated virus
MAADGYPPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQRPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNRQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4867 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaggtacctcggacccttcaacggactcgacaagggagagccggtcaacgaggcagacgccgcggccctcgagcacgacaaggcctacgaccggcagctcgacagcggagacaacccgtacctcaagtacaaccacgtcgacgcggagtttcaggagcgtcttaaagaagatacgtcttttgggggcaacctcggacgagcagtcttccaggccaaaaagaggattcttgaacctctgggcctggttgaggaacctgttaaggcggctccgggagaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggcattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctccccccatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcgccagatacctgactcgtaatctgtaa

SEQ ID NO: 4868 - protein, 735 aa, Adeno-associated virus
MAADGYLPDWLEDTLSEGIRQWWKLKPGPPPPKPAERHKDDSRGLVLPGYRYLGPFNGLDKGEPVNEADAAALEHDKAYDRQLDSGDNPYLKYNHVDAEFQERLKEDTSFGGNLGRAVFQAKKRILEPLGLVEEPVKAAPGEKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGHFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPPMGGFGLKHPPPQILIKNTPVPANPSTTFSAAKFASFITQYSTGQVSVEIEWELQKENSKRWNPEIQYTSNYNKSVNVDFTVDTNGVYSEPRPIGARYLTRNL

SEQ ID NO: 4869 - DNA, 2208 bp, Adeno-associated virus
atggctgccgatggttatcttccagattggctcgaggacaccctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagataacccgtacctcaagtacaaccacgccgacgcggagtttcaggagcgccttaaagaggatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccggcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 4870 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPRPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4871 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaaggagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcggcagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagacgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 4872 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKGDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGGRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQTLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4873 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctgcaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtattttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctacctacctccagagcggcaacacacaagcagctacctcagatgtcaacacacaaggcgttcttccaggcatggtctggcaggacagagacgtgtacctgcgggggcccatctgggcaaagattccacacacggacggacattttcacccctctcccctcatgggcggatttggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 4874 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTCNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTYLQSGNTQAATSDVNTQGVLPGMVWQDRDVYLRGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4875 - DNA, 2208 bp, Adeno-associated virus; identical to SEQ ID NO: 4869

SEQ ID NO: 4876 - protein, 735 aa, Adeno-associated virus; identical to SEQ ID NO: 4870

SEQ ID NO: 4877 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacggcagcaggggtcttgtgcttcctgggtacaagtacctcggacccttcaacggactcgacaagggagagccggtcaacgaggcagacgccgcggccctcgagcacgacaaggcctacgaccggcagctcaacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggagcctgttaaaacggctccgggaaaaaagagaccggtagagcactctcctgcggagccagactcctcctcgggaaccggaaaagcgggccagcagcctgcaagaaagagattgaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccacaagcactcgaacctgggccctgcccacctacaacaaccacctctacaagcaaatctccagccaatcaggagcctcaaacgacaaccactattttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcggacgtcttcatggtcccacagtatggatacctcaccctgaacaacgggagtcaggcggtaggacgctctcccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggacccaccaacatgtctcttcaagctaaaaactggctgcctggaccttgctacagacagcagcgtctgtcaaagcaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcaggaccaccaatcccgtggctacggagcagtacgggactgtgtcaaataatttgcaaaactcaaacactggtccaactactggaactgtcaatcaccaaggagcgttacctggtatggtgtggcaggatcgagatgtgtaccttcagggacccatttgggccaagattcctcacaccgatggacactttcatccttctccactgatgggaggttttggactcaaacacccgcctcctcagattatgatcaaaaacactcccgttccagccaatcctcctacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacaataatggcgtgtactcagagcctcgccccattggcaccagatacctgactcgtaatctgtaa

SEQ ID NO: 4878 - protein, 735 aa, Adeno-associated virus
MAADGYLPDWLEDTLSEGIRQWWKLKPGPPPPKPAERHKDGSRGLVLPGYKYLGPFNGLDKGEPVNEADAAALEHDKAYDRQLNSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSPFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDNNGVYSEPRPIGTRYLTRNL

SEQ ID NO: 4879 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 4880 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4881 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtatttcgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggggtaccagctcccgtacgtcctcggctcggcgcatcaaggatgccttccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacggccaaagtctggaccgtctcatgaatcctctcatcgaccagtacctgtattacttgagcagaacaaacactccaagcggaaccaccacgatgtccaggcttcagttttctcaggccggagcaagtgacgttcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcgtctttggaaaacaagactcgggaaaaactaatgtggacattgaaaaggttatgattacagacgaagaggaaatcaggaccaccaatcccgcggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgtttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 4882 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSGYQLPYVLGSAHQGCLPPFPADVFMVPQYGYLTLNNGSQAVGRSSFYCLEYFPSQMLRTGNNFTFSYTFEDVPFHSSYAHGQSLDRLMNPLIDQYLYYLSRTNTPSGTTTMSRLQFSQAGASDVRDQSRNWLPGPCYRQQRVSKTAADNNNSDYSWTGATKYHLNGRDSLVNPGPAMASHKDDEEKYFPQSGVLVFGKQDSGKTNVDIEKVMITDEEEIRTTNPAATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFVSFITQYSTGQVSVEIEWELQKENSKRWNPEIQYTSNYNKSVNVDFTVDTNGVYSEPRPIGTRYLTRNL

SEQ ID NO: 4883 - DNA, 2208 bp, Adeno-associated virus
atggctgccgatggttatcttccagattggctcgaggacactctctctgaaggaataagacagtggtggaaactcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttctggaacctctgagcctggttgaggagcctgttaagacggctccgggaaaaaagaggccggtagagcactctcccgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagagtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcaggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttttttcctcagagcggggttcttatctttgggaagcaaggctcagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtcgggcaagacagagacgtgtacctgcaggggcctacttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 4884 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLSLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIQDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVGQDRDVYLQGPTWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4885 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcaaaaaagagggttctggaacctctgggcctggttgaggagcctgttaagacggctccgggaaaaaagaggccggtagagcactctcctgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagggtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttttttcctcagagcggggttcttatctttgggaagcaaggcccagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtctggcaagacagagacgtgtacctgcaggggcctatttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 4886 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLGYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGPEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4887 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGPEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4888 - protein, 735 aa, Adeno-associated virus; identical to SEQ ID NO: 4887

SEQ ID NO: 4889 - DNA, 2211 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgcggcctggtttgaggaaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctggacgacagagtcatcgccaccagcacccgaacctgggccctgcccacatacaacaaccacctctacaagcaaatctccagccaatcaggagcctgcaacgacaaccactactttggctacagcaccccctgggggtattttgacttcaacagattccactgccacttttcaccacgtgactggcaaagactcatcaacagcaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcccgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcactgccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaataacaactgcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcaggcccaccaatcccgtggctacggagcagtacgggactgtgtcaaataatttgcaaaactcaaacactggtccaactacaggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaagcactcccgttccagccaatcctcccacaaacttcagttctgccaagtttgcttcttccatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 4890 - protein, 736 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLRPGLRKPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLDDRVIATSTRTWALPTYNNHLYKQISSQSGACNDNHYFGYSTPWGYFDFNRFHCHFSPRDWQRLINSNWGFRPKRLNFKLFNIQVKEVTQNDGTTTIANNLTSTVQVFTDSEYQLPYVPGSAHQGCLPPFPADVFMVPQYGYLTLNNGSQAVGRSSFYCLEYFPSQMLRTGNNFQFSYTFEDVPFHSSYAHCQSLDRLMNPLIDQYLYYLNKTQTNSGTLQQSRLLFSQAGPTNMSLQAKNWLPGPCYRQQRLSKQANDNNNCNFPWTAATKYHLNGRDSLVNPGPAMASHKDDEEKFFPMHGTLIFGKQGTNANDADLENVMITDEEEIRPTNPVATEQYGTVSNNLQNSNTGPTTGTVNHQGALPGMVWQDRDVYLQGPIWAKIPHTDGHFHPSPLMGGFGLKHPPPQIMIKSTPVPANPPTNFSSAKFASSITQYSTGQVSVEIEWELQKENSKRWNPEIQYTSNYNKSVNVDFTVDTNGVYSEPRPIGTRYLTRNL

SEQ ID NO: 4891 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaggatacgtcttttgggggcaacctcggacgagcagtcttccaggcaaaaaagagggttctggaacctctgggcctggttgaggagcctgttaagacggctccgggaaaaaagaggccggtagagcactctcctgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagagtactttccttctcagatgctgcgtaccggaaacagctttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttctttcctcagagcggggttcttatctttgggaagcaaggctcagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtctggcaagacagagacgtgtacctgcaggggcctatttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 4892 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNSFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4893 - DNA, 2211 bp, Adeno-associated virus; identical to SEQ ID NO: 4804

SEQ ID NO: 4894 - protein, 736 aa, Adeno-associated virus
MAADGYLPDWLEDTLSEGIRQWWKLKPGPPPPKPAERHKDDSRGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGSQPAKKKLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGGQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVSTEGVYSEPRPIGTRYLTRNL

SEQ ID NO: 4895 - DNA, 2211 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggttcacagcccgctaaaaagaaactcaatttcggtcagactggcgacacagagtcagtccccgaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatgggagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagcgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctaatgggagggtttggaatgaagcacccgcctcctcagatcctcatcaaaaacacacctgtacctgcggatcctccaacggctttcaataaggacaagctgaactctttcatcacccagtattctactggccaagtcagcgtggagattgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 4896 - protein, 736 aa, Adeno-associated virus
MAADGYLPDWLEDTLSEGIRQWWKLKPGPPPPKPAERHKDDSRGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGSQPAKKKLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 4897 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccggcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 4898 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTGTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4899 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcctttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgagagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 4900 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNESQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4901 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtaccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 4902 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4903 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtactcgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagcaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtccgttaatgtggactttactgtggacactaatggcgtgtattcagagcctcgccccattggcaccagatacctgactcgtaatctgtaa

SEQ ID NO: 4904 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAAGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4905 - protein, 738 aa, Adeno-associated virus; identical to SEQ ID NO: 4797

SEQ ID NO: 4906 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgttcggaaaacagggtgctggaagagacaatgtggactacagcagcgttatgctaaccagcgaagaagaaattaaaaccactaaccccgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 4907 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNCHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4908 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGRTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYLDFNRFHCHFSPRDWQRLINNNWGFRPKRLSFKLFNIQVKEVTQNEGTKTIANNLASTIQVFTDSEYQPPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSRAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPTVGAVNSQGALPGMVWQNRDVYLQGPIWAKIPHTDGNFHPSPLMGGFGLKHPPPQILIKNTPVPADPPTAFNQAKLNSFIAQYSTGQVSVEIEWELQKENSKRWNPEIQYTSNYYKSTNADFAVNTEGVYSEPRPIGTRYLTRNL

SEQ ID NO: 4909 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcggactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagttatcaccaccagcacccgaacctgggccctgcccacctacaacaaccacctctacaagcaaatctccaacgggacctcgggaggcagcaccaacgacaacacctactttggctacagcaccccctgggggtatcttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcgccagcaccatccaggtgtttacggactcggaataccagccgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcgggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctactgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcgcgcagtacagcaccggacaagtcagcgtggagatcgagtgggagctgcagaaggagaacagcaagcgctggaacccagagattcagtatacttccaactactacaaatctacaaatgcggactttgctgttaatactgagggtgtttactctgagcctcgccccattggcactcgttacctcacccgtaatctgtaa

SEQ ID NO: 4910 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggagcctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcgtcaacaacaaccggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 4911 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLVNNNRGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4912 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLSFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNSEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4913 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgagctttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattctgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 4914 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGPVEEAAKTAPGKKRPVEPPPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTVANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4915 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaacctctcggtccggttgaggaagctgctaagacggctcctggaaagaagagaccggtagaaccgccacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccgtcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgttggaacccagagattcagtacacttcaaactactacaaatctacaaatgtggactttgctgtcaatacagagggaacttattctgagcctcgccccattggtactcgttacctcacccgtaatctgtaa

SEQ ID NO: 4916 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQSNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGLGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4917 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagcggctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaagcaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggacttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 4918 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTPFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSYAHSQSLDRLMNPLIVQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSASVDFTVDNNGLYTEPRPIGTRYLTRPL

SEQ ID NO: 4919 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSASVDFTVDNNGLYTEPRPIGTRYLTRPL

SEQ ID NO: 4920 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacccgcggtataaccacgccgacgccgagtttcaggagcgtctgcaagaagatacgccttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctctccacagcagctacgcgcacagccagagcctggaccggctgatgaatcctctcatcgtccaatacctgtattacctgaacagaactcaaaatcagtccggaagtgcccaaaacaaggacttgctgttcagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccagcgttgattttactgtggacaacaatggactttatactgagcctcgccccattggcacccgttaccttacccgtcccctgtaa

SEQ ID NO: 4921 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAETAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYPNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQGRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4922 - DNA, 2211 bp, Adeno-associated virus
atggctgccgatggttatcttccagattggctcgaggacactctctctgaaggaataagacagtggtggaagctcagacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaagaagcgggttctcgaacctctcggtctggttgaggaaggcgctgagacggctcctggaaagaaacgtccggtagagcagtcgccacaagggccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacccgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaaggtagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 4923 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYPNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQGRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4924 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQGRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4925 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4926 - DNA, 2208 bp, Adeno-associated virus
atggctgccgatggctatcttccagattggctcgaggacactctctctgaaggaataagacagtggtggaagctcaaacctggcccaccaccaccaaagcccgcagagcggcatagggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggggtaccagctcccgtacgtcctcggctcggcgcatcaaggatgcctcccgccgttcccagcagacgtcttcatggtgccacagtatggataccccaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccgtggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 4927 - protein, 735 aa, Adeno-associated virus
MAADGYLPDWLEDTLSEGIRQWWKLKPGPPPPKPAERHRDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSGYQLPYVLGSAHQGCLPPFPADVFMVPQYGYPTLNNGSQAVGRSSFYCLEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAVASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4928 - DNA, 2211 bp, Adeno-associated virus
atggctgccgacggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgggcagtcttccaggccaagaagcgggttctcgaacctctcggtctggttgaggaaggcgctaagacggctcctggaaagaaacgtccggtagagcagtcgccacaagagccagactccccctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcactgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggccgcctccctccgttcccggcggacgtgttcatgattccgcaatacggctacctgacgctcaacaatggcagccaagccgtgggacgttcatcctcttactgcctggaatatttcccttctcagatgctgagaacgggcaacaactttaccttcagctacacctttgaggaagtgcctctccacagcagctgcgcgcacagccagagcctggaccggctgatgaatcctctcatcgaccaatacctgtattacctgaacagaactcaaaatcagtccggaagtgcccaaaacagggacttgctgttcagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccgcaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 4929 - protein, 736 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQEPDSPSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGRLPPFPADVFMIPQYGYLTLNNGSQAVGRSSSYCLEYFPSQMLRTGNNFTFSYTFEEVPLHSSCAHSQSLDRLMNPLIDQYLYYLNRTQNQSGSAQNRDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSAGQVSVEIEWELQKENSKRWNPEVQYTSNYAKSANVDFTVDNNGLYTEPRPIGTRYLTRPL

SEQ ID NO: 4930 - protein, 736 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSCAHSQSLDRLMNPLIDQYLYYLNRTQNQSGSAQNRDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4931 - DNA, 2208 bp, Adeno-associated virus
atggctgccgatggctatcttccagattggctcgaggacactctctctgaaggaataagacagtggtggaagctcaaacctggcccaccaccaccaaagcccgcagagcggcatagggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacagtcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggctccagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 4932 - protein, 735 aa, Adeno-associated virus
MAADGYLPDWLEDTLSEGIRQWWKLKPGPPPPKPAERHRDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDSHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4933 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYGTPWGYFDFNRFHCHFSPRDWQRLINNNWGFRPKRLNFKLFNIQVEEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4934 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYGTPWGYFDFNRFHCHFSPRDWQRLINNNWGFRPKRLNFKLFNIQVEEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4935 - DNA, 2211 bp, Adeno-associated virus
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggccagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtacttcaacgggggccagcaacgacaaccactacttcggctacggcaccccctgggggtattttgatttcaacagattccactgccacttttcaccacgtgactggcagcgactcatcaacaacaattggggattccggcccaagagactcaacttcaaactcttcaacatccaagtcgaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaacacaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcaccgctgtggcctcacacaaagacgacgaagacaagttctttcccatgagcggtgtcatgatttttggaaaagagagcgccggagcttcaagcactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 4936 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVEEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4937 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4938 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGANSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 4939 - DNA, 2208 bp, Adeno-associated virus
atggctgccgatggttatcttccagattggctcaaggacactctctctgaaggaataagacagtggtggaagctcaaacctggcccaccaccaccaaagcccgcagagcggcataaggacgacagcgggggtcttgtgcttcctgggtacaagtacctcggacccttcaacggactcgacaagggagagccggtcaacgaggcagacgccgcggccctcgagtacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaacaggaaaagcgggccagcagcctgcgagaaagagattgaattttggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaagttggcattgcgattccacatggatgggcgacagagtcatcaccaccagcacccgaacctgggctctgcccacctacaacaaccatctgtacaagcagatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaggaggtcacgcagaatgacggtacgacgacgattgccaataaccttaccagcacggttcaggtgtttactgactcggagtaccagctcccgtacgtccccggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgcttcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacagctgcggacaacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcagaaccaccaatcccgtggccacggagcagtatggttctgtatctaccaacctccagagcggcaacacacaagcagctactgcagatgtcaacacacaaggcgttcttccaggcatggtctggcaggacagagacgtgcacctgcaggggcctatctgggcaaagattccacacacggacggacattttcacccctctcccctcatgggcggatttggacttaaacaccctcctccacagattctcatcaagaacaccccggtacctgcaaatccttcgaccaccttcagtgcggcaaagtttgcttccttcatcacacagtattccacagggcaggtcagcgtggagatcgagtgggagctgcagaaggagaacagcaaacgctggaaccccgagatccagtacacttccaactacaacaaatctgttaatgtggactttactgtggacactaatggtgtgtattcagagcctcgccccattggcaccagatacctgactcgtaatctgtaa

SEQ ID NO: 4940 - protein, 735 aa, Adeno-associated virus
MAADGYLPDWLKDTLSEGIRQWWKLKPGPPPPKPAERHKDDSGGLVLPGYKYLGPFNGLDKGEPVNEADAAALEYDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGSWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVPGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVWQDRDVHLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4941 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcgcaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 4942 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASRKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4943 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgtcaagacggctccaggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcggctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtacggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 4944 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSGYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4945 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaatcggcattgcgattccacatggatgggcgacagagtcatcaccaccagcacccgaacctgggccctgcccacctacaacaaccacctctacagacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgagcaacgggagtcaggcagtaggacgctcttcattttactgcccggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacctaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatttgtaa

SEQ ID NO: 4946 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNRHCDSTWMGDRVITTSTRTWALPTYNNHLYRQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLSNGSQAVGRSSFYCPEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGPKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4947 - DNA, 2205 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcagacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtactacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 4948 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLRQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQTASGTQQSRLLFSQAGPTSMSLQAKNWLPGPCYRQQRLSKQANDNNNSNFPWTGATKYYLNGRDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4949 - DNA, 3160 bp, Adeno-associated virus
acccttcactaaagggactagtcctgcaggtttaaacgaattcgcccttgctgcgtcaactggaccaatgagaactttcccttcaacgactgtgtcgacaagatggtgatttggtgggaggaggggaagatgaccgccaaggtcgtggagtcggccaaagccattctcggaggaagcaaggtgcgcgtggaccagaaatgcaagtcctcggcccagatagatccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcgggaagtcaaagactttttccggtgggcaaaggatcacgtggttgaggtggagcatgaattctacgtcaaaaagggtggagccaagaaaagacccgcccctagtgacgcagatataagtgagcccaaacgggtgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgtgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcagacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtactacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaatcaatcg

SEQ ID NO: 4950 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCRFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQGLDRLMNPLIDQYLYYLNRTQTASGTQQSRLLFSQAGPTSMSLQAKNWLPGPCYRQQRLSKQANDNNNSNFPWTGATKYHLNGGDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLRGPIWAKIPHADGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4951 - DNA, 3157 bp, Adeno-associated virus
ctcactaagggactagtcctgcaggtttaaacgaattcgcccttgctgcgtcaactggaccaatgagaactttcccttcaacgactgtgtcgacaagatggtgatttggtgggaggaggggaagatgaccgccaaggtcgtggagtcggccaaagccactctcggaggaagcaaggtgcgcgtggaccagaaacgcaagtcctcggcccagatagatccgactcccgtgatcgtcacctccaacaccaacatgtgcgccgtgattgacgggaactcaacgaccttcgaacaccagcagccgttgcaagaccgaatgttcaaatttgaactcacccgccgtctggatcatgacttcgggaaggtcaccaagcaggaagtcaaagactttttccggtgggcaaaggatcacgtggttgaggtggagcatgaattctacgtcaaaaagggtggagccaagaaaagacccgcccctagtgacgcagatataagtgagcccaaacgggtgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgtgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggctctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccgcttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagggtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtaccacctcaatggcggagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcggggacccatttgggccaagattcctcacgccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaattcaattcg

SEQ ID NO: 4952 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLECFPSQMLRTGNNFQFSYTFEDVPFHSSYAHSQSLDRLMNPLIDQYLYYLNRTQTASGTQQSRLLFSQAGPTSMSLQAKNWLPGPCYRQQRLSKQANDNNNSNFPWTGATKYHLNGRDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4953 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggcaaccagcctgcaagaaaaagattgaatttcggtcagactggagacgcagactccgtacctgacccccagcctctcggacagccaccagcatccccctctggtctgggaactaatacgatggctacaggcagtggcgcaccaatggcagacaataacgagggcgccgacggagtgggtaattcctcgggaaattggcattgcgattccacatggatgggcgacagagtcgtcaccaccagcacccgcacctgggccctgcccacctacaacaaccacctctacaagcagatttccagccaatcaggagccagcaacgacaaccactactttggctacagcaccccttgggggtattttgacttcaacagattccactgccacttttcgccacgcgactggcagagactcatcaacaacaactggggattccggcccaaaagactcaacttcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgcaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaa

SEQ ID NO: 4954 - DNA, 3159 bp, Adeno-associated virus
gattgatttagcggccgcgaattcgcccttgctgcgtcaactggaccaatgagaactttcccttcaacgattgcgtcgacaagatggtgatctggtgggaggagggaaagatgaccgccaaggtcgtggagtcggccaaagccattctcggaggaagcaaggtgcgtgtggaccaaaagtgcaagtcttcggcccagatcgacccgactcccgtgatcgtcacctccaacaccaacatgtgcgccgtgattgatggaaactcaacgaccttcgagcaccagcagccgttgcaagaccggatgttcaaatttgaacttacccgccgtctggatcatgactttggaaaggtcaccaagcaggaagtgaaagactttttccggtgggcaaaggatcacgtggttgaggtggagcatgagttctacgtcaaaaagggtggagccaaaaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcagaattcaaatatctgcttcactcacggacagaaagactgtccatagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggcaaccagcctgcaagaaaaagattgaatttcggtcagactggagacgcagactccgtacctgacccccagcctctcggacagccaccagcatccccctctggtctgggaactaatacgatggctacaggcagtggcgcaccaatggcagacaataacgagggcgccgacggagtgggtaattcctcgggaaattggcattgcgattccacatggatgggcgacagagtcgtcaccaccagcacccgcacctgggccctgcccacctacaacaaccacctctacaagcagatttccagccaatcaggagccagcaacgacaaccactactttggctacagcaccccttgggggtattttgacttcaacagattccactgccacttttcgccacgcgactggcagagactcatcaacaacaactggggattccggcccaaaagactcaacttcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgcaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaattgcttgttaatcaataaaccgtttaattcgtttcagttgaactttggtctctgcgaagggcgaattcgtttaaacctgcaggactagtccctttagtgagg

SEQ ID NO: 4955 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPASPSGLGTNTMATGSGAPMADNNEGADGVGNSSGNWHCDSTWMGDRVVTTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDLEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4956 - DNA, 2205 bp, Adeno-associated virus
atggctgccgatggttatcttccagattggctcgaggacactctctctgaaggaataagacagtggtggaagctcaaacctggcccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggcccgtagagcactctcctgtggagccagactcctcctcgggaaccggaaaagcgggcaaccagcctgcaagaaaaagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggagattggcattgcgattccacatggatgggcgacagagtcatcaccaccagcacccgcacctgggccctgcccacctacaacaaccacctctacaagcagatttccagccaatcaggagccagcaatgacaaccactactttggctacagcaccccttgggggtattttgacttcaacagattccactgccacttttcgccacgcgactggcagagactcatcaacaacaactggggattccggcccaaaagactcaacctcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgtaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacggtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacgagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaa

SEQ ID NO: 4957 - DNA, 3156 bp, Adeno-associated virus
cgattgaatttagcggccgcgaattcgcccttgctgcgtcaacggaccaatgagaactttcccttcaacgattgcgtcgacaagatggtgatctggtgggaggagggaaagatgaccgccaaggtcgtggagtcggccaaagccattctcggaggaagcaaggtgcgtgtggaccaaaagtgcaagtcttcggcccagatcgacccgactcccgtgatcgtcacctccaacaccaacatgtgcgccgtgattgatggaaactcaacgaccttcgagcaccagcagccgttgcaagaccggatgttcaaatttgaacttacccgccgtctggatcatgactttggaaaggtcaccaagcaggaagtgaaagactttttccggtgggcaaaggatcacgtggttgaggtggagcatgagttctacgtcaaaaagggtggagccaaaaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagcgaatgaatcagaattcaaatatctgcttcactcacggacagaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggcccgtagagcactctcctgtggagccagactcctcctcgggaaccggaaaagcgggcaaccagcctgcaagaaaaagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggagattggcattgcgattccacatggatgggcgacagagtcatcaccaccagcacccgcacctgggccctgcccacctacaacaaccacctctacaagcagatttccagccaatcaggagccagcaatgacaaccactactttggctacagcaccccttgggggtattttgacttcaacagattccactgccacttttcgccacgcgactggcagagactcatcaacaacaactggggattccggcccaaaagactcaacctcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgtaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacggtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacgagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaattgcttgttaatcaataaaccgtttaattcgtttcagttgaactttggtctctgcgaagggcgaattcgtttaaacctgcaggactagtccctttagtgag

SEQ ID NO: 4958 - protein, 734 aa, Adeno-associated virus
MAADGYLPDWLEDTLSEGIRQWWKLKPGPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGTNTMATGSGAPMADNNEGADGVGNSSGDWHCDSTWMGDRVITTSTRTWALPTYNNHLYKQISSQSGASNDNHYFGYSTPWGYFDFNRFHCHFSPRDWQRLINNNWGFRPKRLNLKLFNIQVKEVTQNDGTTTIANNLTSTVQVFTDLEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNGEYSWTGATKYHLNGRDSLVNPGPAMASHKDDEEKFFPQSGVLIFGKQGSEKTNVDIEKVMITDEEEIRTTNPVATEQYGSVSTNLQSGNTRAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4959 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacgaccacgccgacgcggagtttcaggagcgccttaaagaagatacgtcttttgggggcaacctcggacgagcagtcttccaggcaaaaaagagggttcttgaacctctgggcctggttgaggagcctgttaagacggctccgggaaaaaagaggccggtagagcactctcctgtggagccagactcctcctcgggaaccggaaaagcgggcaaccagcctgcaagaaagagattgaatttcggtcagactggagacgcagactccgtacctgacccccagcctctcggacagccaccagcagccccctctggtctgggaactaatacgatggctacaggcagtggcgcaccaatggcagacaataacgatggcgccgacggagtgggtaattcctcgggaaattggcattgcgattccacatggatgggcgacagagtcatcaccaccagcacccgaacctgggctctgcccacctacaacaaccatctgtacaagcagatttccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcagagaggtcacgcagaatgatggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtacttcccttctcagatgctgcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggatcagtctaggaactggcttcctggaccctgttaccgccagcagcgagtatcaaagacatctgcggacaacaacaacagtgaatactcgtggattggagctaccaagtaccacctcaatggcagagactctctggtgaatccgggcccggcaatggccagccacaaggacgatgaagaaaagttttttcctcagagcggggttctcatctttggaaaacaaggatcagagaaaacaaatgtggacattgaaaaggtcatgattacagacgaagaggaaatcagaaccaccaatcccgtggccacggagcagtatggttctgtatctaccaacctccagagcggcaacacacaagcatctactgcagatgtcaacacacaaggcgttcttccaggcatggtctggcaggacagagacgtgtacctgcaggggcctatctgggcaaagattccgcacacggacggacattttcacccctctcccctcatgggcggattcggacttaaacaccctcctccacagattctcatcaaaaacaccccggtacctgcgaatccttcgaccaccttcagtgcggcaaagtttgcttccttcatcacacagtattccacggggcgggtcagcgtggagatcgagtgggagctacagaaggagaacagcaaacgctggaatcccgagatccagtacacttccaactacaacaaatctgttaatgtggactttactgtggacactaatggtgtgtattcagagcctcgccccattggcaccagatacctgactcgtaatctgtaa

SEQ ID NO: 4960 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYDHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGTNTMATGSGAPMADNNDGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVREVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWIGATKYHLNGRDSLVNPGPAMASHKDDEEKFFPQSGVLIFGKQGSEKTNVDIEKVMITDEEEIRTTNPVATEQYGSVSTNLQSGNTQASTADVNTQGVLPGMVWQDRDVYLQGPIWAKIPHTDGHFHPSPLMGGFGLKHPPPQILIKNTPVPANPSTTFSAAKFASFITQYSTGRVSVEIEWELQKENSKRWNPEIQYTSNYNKSVNVDFTVDTNGVYSEPRPIGTRYLTRNL

SEQ ID NO: 4961 - DNA, 2217 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccgcatggctgggcgacagagtcatcaccaccagcacccgaccctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaa

SEQ ID NO: 4962 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSAWLGDRVITTSTRPWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4963 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLVDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4964 - DNA, 3158 bp, Adeno-associated virus
gattgaatttagcggccgcgaattcgcccttgctgcgtcaactggaccaatgagaactttcctttcaatgattgcgtcgacaagatggtgatctggtgggaggagggaaagatgaccgccaaggtcgtggagtcggccaaagccattctcggaggaagcaaggtgcgcgcggaccagaaatgcaagtcctcggcccagatagacccgactcccgtgattgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagctaagaaaagacccgcccccagtgacgcagatataagtgagcccaaacgggcgcgcgagtcagttgcgcagccatcgacgtcagacgcggaagcttcgatcaactacgcgggcaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggaacctgttaaaacggctccgggaaaaaagaggccggtagagcactctcctgtggagccagactcctcctcgggaaccggaaaagcgggccagcagcctgcaagaaaaagattgaatttcggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcgggaaattggcattgcgattcccaatggctgggcgacagagtcatcaccaccagcacccgcacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcagtaggacgctcttcattttactgcctggagtactttccttctcagatgctgcgtaccggaaacaactttcaattcagctacacttttgaagacgtgcctttccacagcagctacgctcacagccagagtctggatcggctgatgaatcctctggtcgaccagtacctgtattatctgaacaagacacaaacaaatagtggaactcttcagcagtctcggctactgtttagccaagctggacccaccaacatgtctcttcaagctaaaaactggctgcctggaccttgctacagacagcagcgtctgtcaaagcaggcaaacgacaacaacaacagcaactttccctggactgcagctacaaagtatcatctaaatggccgggactcgttggttaatccaggaccagctatggccagtcacaaggatgacgaagaaaagtttttccccatgcatggaacccttatatttggtaaacaaggaacaaatgccaacgacgcggatttggaaaatgtcatgattacagatgaagaagaaatcaggaccaccaatcccgtggctacggagcagtacggaactgtatcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccacctcctcaaatcatgatcaaaaacactcccgttccagccaatcctcccacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaacctgcaggactagtccctttagtga

SEQ ID NO: 4965 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHPPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNRLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLVGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4966 - DNA, 3159 bp, Adeno-associated virus
gattgaatttagcggccgcgaattcgcccttgctgcgtcaactggaccaatgagaactttcctttcaatgattgcgtcgacaagatggtgatctggtgggaggagggaaagatgaccgccaaggtcgtggagtcggccaaagccattctcggaggaagcaaggtgcgcgtggaccagaaatgcaagtcctcggcccagatagacccgactcccgtgattgtcacctccaacaccgacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagctaagaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggaacctgttaaaacggctccgggaaaaaagaggccggtagagcaccctcctgtggagccagactcctcctcgggaaccggaaaagcgggccagcagcctgcaagaaaaagattgaatttcggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcgggaaattggcattgcgattcccaatggctgggcgacagagtcatcaccaccagcacccgcacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcagtaggacgctcttcattttactgcctggagtactttccttctcagatgctgcgtaccggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggacccaccaacatgtctcttcaagctaaaaaccggctgcctggaccttgctacagacagcagcgtctgtcaaagcaggcaaacgacaacaacaacagcaactttccctggaccgcagctacaaagtatcatctaaatggccgggactcgttggttaatccaggaccagctatggccagtcacaaggatgacgaagaaaagtttttccccatgcatggaacccttatatttggtaaacaaggaacaaatgccaacgacgcggatttggaaaatgtcatgattacagatgaagaagaaatcaggaccaccaatcccgtggctacggagcagtacggaactgtatcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactggtgggaggttttggactcaaacacccacctcctcaaatcatgatcaaaaacactcccgttccagccaatcctcccacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaacctgcaggactagtccctttagtgag

SEQ ID NO: 4967 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtaccttggacccttcaacggactcgacaagggagagccggtcaacgaggcagacgccgcggccctcgagcacgacaaggcctacgaccggcagctcgacagcggagacaacccgtaccccaagtacaaccacgccgacgcggagttccaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaagagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccacctctacaagcagatttccagccaatcaggagcctcaaacgacaaccactactttggctacagcaccccttgggggtattttgacttcaacagattccactgccacttttcgccacgtgactggcaaagactcatcaacaacaattggggattccggcccaaaagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgcccacagccagagtttggaccgtctcatgaatcctctcatcgaccagtacctgtattacttgagcagaacaaacactccaagcggaaccaccacgcagtcaaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccaccttaatggaagagactctctggtgaatccgggcccggccatggccagccacaaggacgatgaagaaaagttttttcctcagagcggggttctcatctttggaaaacaagactcgggaaaaactaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtgtggcaggacagagacgtgtacctgcaggggcccatctgggcaaagattccacacacggacggacattttcacccctctcccctcatgggcggattcggacttaaacaccctcccccgcagattctcatcaagaacaccccggtacctgcgaatccttcgactaccttcagtgcggcaaagtttgcttccttcattacacagtactccacggggcaggtcagcgtggagatcgagtgggagctgcagaaggagaacagcaaacgctggaatcccgagattcagtacacttccaactacaacaaatctgttaatgtggactttactgtggacactaatggtgtgtattcagagcctcgccccattggcaccaggtacctgactcgtaatctgtaa

SEQ ID NO: 4968 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYPKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4969 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtaccttggacccttcaacggactcgacaagggagagccggtcaacgaggcagacgccgcggccctcgagcacgacaaggcctacgaccggcagctcgacggcggagacaacccgtacctcaagtacaaccacgccgacgcggagttccaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcttgcggagccagactcctcctcgggaaccggaaaagcgggccagcagcctgcaagaaggagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccacctctacaggcagatttccagccaatcaggagcctcaaacgacaaccactactttggctacagcaccccttgggggtattttgacttcaacagattccactgccacttttcgccacgtgactggcaaagactcatcaacaacaattggggatcccggcccaaaagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgcccacagccagagtttggaccgtctcatgaatcctctcgtcgaccagtacctgtattacttgagcagaacaaacactccaagcggaaccaccacgcagtcaaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccaccttaatggaagagactctctggtgaatccgggcccggccatggccagccacaaggacgatgaagaaaagttttttcctcagagcggggttctcatctttggaaaacaagactcgggaaaaactaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtgtggcaggacagagacgtgtacctgcaggggcccatctgggcaaagattccacacacggacggacattttcacccctctcccctcatgggcggattcggacttaaacaccctcccccgcagattctcatcaagaacaccccggtacctgcgaatccttcgactaccttcagtgcggcaaagtttgcttccttcattacacagtactccacggggcaggtcagcgtggagatcgagtgggagctgcagaaggagaacagcaaacgctggaatcccgagattcagtacacttccaactacaacaaatctgttaatgtggactttactgtggacactaatggtgtgtattcagagcctcgccccattggcaccagatacctgactcgtaatctgtaa

SEQ ID NO: 4970 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDGGDNPYLKYNHADAEFQERLKEDTSFGGNLGRAVFQAKKRVLEPLGLVEEPVKTAPGKKRPVEHSLAEPDSSSGTGKAGQQPARRRLNFGQTGDADSVPDPQPLGQPPAAPSGLGTNTMATGSGAPMADNNEGADGVGNSSGNWHCDSTWMGDRVITTSTRTWALPTYNNHLYRQISSQSGASNDNHYFGYSTPWGYFDFNRFHCHFSPRDWQRLINNNWGSRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLVDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4971 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSAGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTETIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSCAHSQSSDRLMNPLIDQYLYYLSRTRSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4972 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcttggctacaagtacctcggacccttcaacggactcgacaagggggagcccgtcaatgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcggctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacgacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 4973 - protein, 738 aa, Adeno-associated virus
MAADGYLPDWLEDNLSEGIREWWDLKPGAPKPKANQQKQDDGRGLVLLGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSGYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 4974 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEPPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4975 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEGPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4976 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgagggacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggaactcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtatcacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 4977 - DNA, 2211 bp, Adeno-associated virus
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 4978 - DNA, 2208 bp, Adeno-associated virus
atggctgccgatggttatcttccagattggctcgaggacactctctctgaaggaacaagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggaactcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtaccacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 4979 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccacctgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggagggagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaactgccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 4980 - protein, 735 aa, Adeno-associated virus
MAADGYLPDWLEDTLSEGTRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 4981 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcatcaggacaacagcaggggtcttgtgcttcctgggtacaagtacctcggaccctccaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctgcagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtacccgctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtaccggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagccttgccccattggcaccagatacctgactcgtaatctgtaa

SEQ ID NO: 4982 - protein, 735 aa, Adeno-associated virus
MAADGYLPDWLEDTLSEGIRQWWKLKPGPPPPKPAERHQDNSRGLVLPGYKYLGPSNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGCSTPWGYFDFNRFHCHFSPRDWQRLINNNWGFRPKRLNFKLFNIQVKEVTQNDGTTTIANNLTSTVQVFTDSEYPLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPCPIGTRYLTRNL

SEQ ID NO: 4983 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccagcagcccgcgaaaaagagactgaattttgggcagactggcgactcagagtcagtgcctgacccccaacctctctcagaaccacccgcaggtccctctggtctgggatctggtacaatggctgctggcggtggcgctccaatggcagacaataacgaaggcgccgacggagtgggtaatgtctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgtgactggcagcgactcatcaacaacaactgggggttccggcccaagaagctcaacttcaagctcttcaacatccaggtcaaggaggtcacccagaatgaaggcaccaagaccatcgccaataacctcaccagcacggtgcaggtctttacggactcggagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacgacagtgtcgcaaaacaacaacagcaactttacctggaccggggcgaccaagtaccacctgaacggccgagactccctggtgagccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggcgtggtggctgacaatctgcagcagaccaactcagctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagtgaaccccgccccattggcactcgttacctcacccgtaatctgtaa

SEQ ID NO: 4984 - protein, 731 aa, Adeno-associated virus
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGQQPAKKRLNFGQTGDSESVPDPQPLSEPPAGPSGLGSGTMAAGGGAPMADNNEGADGVGNVSGNWHCDSTWLGDRVITTSTRTWALPTYNNHLYKQISNGTSGGSSNDNTYFGYSTPWGYFDFNRFHCHFSPRDWQRLINNNWGFRPKKLNFKLFNIQVKEVTQNEGTKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTTVSQNNNSNFTWTGATKYHLNGRDSLVSPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 4985 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccggcagcccgcgaaaaagagactgaattttgggcagactggcgactcagagtcagtgcctgacccccaacctctctcagaaccacccgcaggtccctctggtctgggatctggtacaatggctgcaggcggtggcgctccaatggcagacaataacgaaggcgccgacggagtgggtaatgcctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgtgactggcagcgactcatcaacaacaactggggattccggcccaagaggctcaacttcaagctcttcaacatccaggtcaaggaggtcacccagaatgaaggcaccaagaccatcgccaataacctcaccagcacggtgcaggtctttacggactcgaagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacgacagtgtcgcaaaacaacaacagcaactttacctggaccggggcgaccaagtaccacctgaacggccgagactccctggtgaaccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggtgtggtggctgacaatctgcagcagaccaactcggctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagtgaaccccgccccattggcactcgttacctcacccgtaatctgtaa

SEQ ID NO: 4986 - protein, 731 aa, Adeno-associated virus
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGRQPAKKRLNFGQTGDSESVPDPQPLSEPPAGPSGLGSGTMAAGGGAPMADNNEGADGVGNASGNWHCDSTWLGDRVITTSTRTWALPTYNNHLYKQISNGTSGGSSNDNTYFGYSTPWGYFDFNRFHCHFSPRDWQRLINNNWGFRPKRLNFKLFNIQVKEVTQNEGTKTIANNLTSTVQVFTDSKYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTTVSQNNNSNFTWTGATKYHLNGRDSLVNPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 4987 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccagcagcccgcgaaaaagagactgaattttgggccgactggcgactcagagtcagtgcctgacccccaacctctctcagaaccacctgcaggtccctctggtctgggatctggtacaatggctgcaggcggtggcgctccaatggcagacaataacgaaggcgccgacggagtgggtaatgtctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgcgactggcagcgactcatcaacaacaactggggattccggcccaagaagctcaacttcaagctcttcaacatccaggtcaaggaggtcacccagaatgaaggcaccaagaccaccgccaataacctcaccagcacggtgcaggtctttacggactcggagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacggcagtgtcgcaaaacaacaacagcaactttacctggaccggggcgaccaagtaccacctgaacggccgagactccctggtgaaccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggtgtggtggctgacaatctgcagcagaccaactcggctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagcgaaccccgccccattggcactcgttacctcacccgtaatctgtaa

SEQ ID NO: 4988 - protein, 731 aa, Adeno-associated virus
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGQQPAKKRLNFGPTGDSESVPDPQPLSEPPAGPSGLGSGTMAAGGGAPMADNNEGADGVGNVSGNWHCDSTWLGDRVITTSTRTWALPTYNNHLYKQISNGTSGGSSNDNTYFGYSTPWGYFDFNRFHCHFSPRDWQRLINNNWGFRPKKLNFKLFNIQVKEVTQNEGTKTTANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTAVSQNNNSNFTWTGATKYHLNGRDSLVNPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 4989 - DNA, 4404 bp, Adeno-associated virus
atggctgccgatggttatcttccagattggctcgagggcaacctctctgagggcattcgcgagtggtgggacttgaaacctggagccccgaaacccaaagccaaccagcaaaagcaggacgacggccggggtctggtgcttcctggctacaggtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaacggccagccgcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcgataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaaatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccatcggcacccgttacctcacccgtaatctgtaa

SEQ ID NO: 4990 - protein, 738 aa, Adeno-associated virus; identical to SEQ ID NO: 4793

SEQ ID NO: 4991 - protein, 738 aa, Adeno-associated virus; identical to SEQ ID NO: 4793

SEQ ID NO: 4992 - DNA, 2501 bp, Adeno-associated virus
gaattcgcccttggctgcgtcaactggaccaatgagaactttcccttcaacgattgcgtcgacaagatggtgatctggtgggaggagggcaagatgacggccaaggtcgtggagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgagacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagagactcaactttgggcagactggcgactcagagtcagtgcccgaccctcaaccaatcggagaaccccccgcaggcccctctggtctgggatctggcacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctatgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacagtgtcgcaaaataacaacagcaactttgcttggaccggtgccaccaagtatcatctgaatggcagagactctctggtaaatcccggtgtcgctatggcaacgcacaagggcgacgaagagcgattttttccatccagcggagtcttgatgtttgggaaacagggagctggaaaagacaacgtagactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttgattcgtttcagttgaactttggtctcaagggcgaattc

SEQ ID NO: 4993 - DNA, 2187 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcgaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaa

SEQ ID NO: 4994 - protein, 728 aa, Adeno-associated virus; identical to SEQ ID NO: 4765

SEQ ID NO: 4995 - protein, 728 aa, Adeno-associated virus; identical to SEQ ID NO: 4829

SEQ ID NO: 4996 - protein, 728 aa, Adeno-associated virus; identical to SEQ ID NO: 4829

SEQ ID NO: 4997 - DNA, 3113 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgcttccctgcaagacatgcgagagaatgaatcagaatttcagcatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggtcatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatagctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacagctggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 4998 - DNA, 3106 bp, Adeno-associated virus
gaattcgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggcgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcccgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccgggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaaccggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctaccagtttgaggacgtgccctttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggcctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 4999 - DNA, 3197 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattcgtttaaacctgcaggactagtccctttagtgagggttaattctgagcttggcgtaatcatgggtcatag

SEQ ID NO: 5000 - DNA, 3276 bp, Adeno-associated virus
gaattcgcccttcgcagagaccaaagttcaactgaaacgaattaaccggtttattgattaacaggcaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgtccatcaggggagacgggtgaaagttgccgtccgtgtgaggaattttggcccagatgggaccctgcaggtacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtccaggctctggctatgcgcatagctgctgtggaaaggcacttcctcaaaggtgtagctgaattcaaagttattgcccgttctcagcatctgagaaggaaagtactccaggcagtagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgtccgtcgtgacctccttgacctggatgttgaacaacttgaaccgcagctttctgggccggaatccccagttgttgttgatgagtcgctgccagtcacgtggtgagaagtggcagtggaatctgttaaagtcaaaatacccccagggggtgctgtagccgaagtaggtgttgtcgttggtgcttcctcccgatgtcccgttggagatttgcttgtagaggtggttgttgtaggtggggagggcccaggttcgggtgctggtggtgatgactctgtcgcccagccatgtggaatcgcaatgccaatttcctgaggaactacccactccgtcggcgccttcgttattgtctgccattggagcgccaccgcctgcagccattgtaccagatcccagaccagaggggcctgcggggggttctccgattggttgagggtcgggcactgactctgagtcgccagtctgcccaaagttgagtctctttttcgcgggctgctggcctgtcttgccgatgcccgtagaggagtctggagaacgctggggtgatggctctaccggtctcttctttccaggagccgtcttagcgccttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcagggaaacagcatctgaagcatgcccgcgtgacgagaacacttgttttggtacctgtcggcaaagtccaccggagctccttccgcgtctgacgtcgatggatgcaaaatgtcgcaaaagcactcacgtgacagctaatacaggaccactcccctatgacgtgatttacgtcagcgctatgcccgcgtgacgagaacatttgttttggtacctgtcggcaaagtccaccggagctccttccgcgtctgacgtcgatggatccgcgactgaggggcaggcccgcttgggctcgcttttatccgcgtcatcgggggcgggtctcttgttggctccaccctttctgacgtagaactcatgcgccacctcggtcacgtgatcctgcgcccagcggaagaactctttgacttcctgctttgtcaccttgccaaagtcatgctccagacggcgggtgagttcaaatttgaacatccggtcctgcaacggctgctggtgctcgaaggtggtgctgttcccgtcaatcacggcgcacatgttggtgttggaagtgacgatcacgggggtgggatcgatctgggcggaagacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagccgtagaaagggcgaattc

SEQ ID NO: 5001 - protein, 738 aa, Adeno-associated virus; identical to SEQ ID NO: 4777

SEQ ID NO: 5002 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGHQPARKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVPGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQTNGAPIVGTVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 5003 - protein, 738 aa, Adeno-associated virus; identical to SEQ ID NO: 4775

SEQ ID NO: 5004 - DNA, 2489 bp, Adeno-associated virus
gaattcgccctttctacggctgcgtcaactggaccaatgagaactttcccttcaacgattgcgtcgacaagatggtgatctggtgggaggagggcaagatgacggccaaggtcgtgaagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaggaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgccaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaattgcctgttaatcaataaaccggttaattcgtttcagttgaactttggtcaagggcgaattc

SEQ ID NO: 5005 - DNA, 3098 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcttccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccggagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcggcagagactgtcaaaagacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagagaacagcaaacgctggaatccagagattcagtacacctcaaattatgccaagtctaataatgtggaatttgctgtcaacaacgaaggggtttatactgagcctcgccccattggcacccgttacctcacccgtaacctgtaattacttgttaatcaataaaccggttgattcgtttcagttgaactttggtctctgcgaagggcgaattc

SEQ ID NO: 5006 - DNA, 2969 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcatccgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgacgaaccccctcatcgaccagtacctgtactacctggcccggacccagagcactacggggtccacaagggggctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 5007 - DNA, 3113 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctatgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacagtgtcgcaaaataacaacagcaactttgcttggaccggtgccaccaagtatcatctgaatggcagagactctctggtaaatcccggtgtcgctatggcaacgcacaagggcgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtagcctgtaattgcctgttaatcaataaaccggttgattcgtttcagttgaactttggtctctgcgaagggcgaattc

SEQ ID NO: 5008 - DNA, 3128 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcgcgggaccagagactgttcagaatgtttcccgggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 5009 - protein, 738 aa, Adeno-associated virus; identical to SEQ ID NO: 5002

SEQ ID NO: 5010 - DNA, 1933 bp, Adeno-associated virus
  modified_base (1302)..(1302): a, c, t or g
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggtgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatgnaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagtttgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 5011 - DNA, 3105 bp, Adeno-associated virus
gaattcgcccttgctgcgtcaactggaccaatgagaactttcccttcaacgattgcgtcgacaagatggtgatctggtgggaggagggcaagatgaccgccaaggtcgtggagtccgccaaggccattctgggcggaagcaaggtgcgcgtggaccaaaagtgcaagtcatcggcccagatcgaccccacgcccgtgatcgtcacctccaacaccaacatgtgcgccgtgatcgacgggaacagcaccaccttcgagcaccagcagccgctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcagaatctcaacccgtcgtcagaaaaaagacgtatcagaaactgtgcgcgattcatcatctgctggggcgggcacccgagattgcgtgttcggcccgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaacctctgggcctggttgaagaaggtgctaagacggctcctggaaagaagagaccgttagagtcaccacaagagcccgactcctcctcaggaatcggcaaaaaaggcaaacaaccagccaaaaagagactcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcggctcggaacaacatcaaacagcaacacctacaacggattctccaccccctggggatactttgactttaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagagggaagtctgtctcctttccccaatgacgtcttcatggtgcctcaatatggctactgtggcattgtgactggcgaaaatcagaaccagacggacagaaatgctttctactgcctggagtattttccttcacaaatgctgagaactggcaataactttgaaatggcttacaactttgggaaggtgccgttccactcaatgtatgcttacagccagagcccggacagactgatgaatcccctcctggaccagtacctgtggcacttacagtcgaccacctctggagagactctgaatcaaggcaatgcagcaaccacatttggaaaaatcaggagtggagactttgccttttacagaaagaactggctgcctgggccttgtgttaaacagcagagactctcaaaaactgccagtcaaaattacaagattcctgccagcgggggcaacgctctgttaaagtatgacacccactataccttaaacaaccgctggagcaacatagcgcctggacctccaatggcaacagctggaccttcagatggggacttcagcaacgcccagctcatcttccctggaccatcagtcaccggaaacacaacaacctcagcaaacaatctgttgtttacatcagaagaagaaattgctgccaccaacccaagagacacggacatgtttggtcagattgctgacaataatcagaatgctacaactgctcccataaccggcaacgtgactgctatgggagtgcttcctggcatggtgtggcaaaacagagacatttactaccaagggccaatttgggccaagatcccacacgcggacggacattttcatccttcaccgctaattggcggttttggactgaaacatccgcctccccagatatttatcaaaaacacccccgtacctgccaatcctgcgacaaccttcactgcagccagagtggactctttcatcacacaatacagcaccggccaggtcgctgttcagattgaatgggaaatcgaaaaggaacgctccaaacgctggaatcctgaagtgcagtttacttcaaactatgggaaccagtcttctatgttgtgggctcccgatacaactgggaagtatacagagccgcgggttattggctctcgttatttgactaatcatttgtaactgcctagttaatcaataaaccgtgtgattcgtttcagttgaactttggtctctgcgaagggcgaattc

SEQ ID NO: 5012 - protein, 733 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFEMAYNFEKVPFHSMYAHSQSLDRLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRWNPEVQFTSNYGNQSSMLWAPDTTGKYTEPRVIGSRYLTNHL

SEQ ID NO: 5013 - DNA, 3105 bp, Adeno-associated virus
gaattcgcccttgctgcgtcaactggaccaatgagaactttcccttcaacgattgcgtcgacaagatggtgatctggtgggaggagggcaagatgaccgccaaggtcgtggagtccgccaaggccattctgggcggaagcaaggtgcgcgtggaccaaaagtgcaagtcatcggcccagatcgaccccacgcccgtgatcgtcacctccaacaccaacatgtgcgccgtgatcgacgggaacagcaccaccttcgagcaccagcagccgctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcagaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagctcaaggccaaccagcagaagcaggacgacggccggggtctggtgcttcctggctacaagtacctcggacccttccacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaaccactgggcctggttgaagaaggtgctaagacggctcctggaaagaagagaccgttagagtcaccacaagagcccgactcctcctcaggaatcggcaaaaaaggcaaacaaccagccaaaaagagactcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcggctcggaacaacatcaaacagcaacacctacaacggattctccaccccctggggatactttgactttaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagagggaagtctgcctcctttccccaatgacgtcttcatggtgcctcaatatggctactgtggcattgtgactggcgaaaatcagaaccagacggacagaaatgctttctactgcctggagtattttccttcacaaatgctgagaactggcaataactttgaaatggcttacaactttgagaaggtgccgttccactcaatgtatgctcacagccagagcctggacagactgatgaatcccctcctggaccagtacctgtggcacttacagtcgaccacctctggagagactctgaatcaaggcaatgcagcaaccacatttggaaaaatcaggagtggagactttgccttttacagaaagaactggctgcctgggccttgtgttaaacagcagagattctcaaaaactgccagtcaaaattacaagattcctgccagcgggggcaacgctctgttaaagtatgacacccactataccttaaacaaccgctggagcaacatagcgcctggacctccaatggcaacagctggaccttcagatggggacttcagcaacgcccagctcatcttccctggaccatcagtcaccggaaacacaacaacctcagcaaacaatctgttgtttacatcagaaggagaaattgctgccaccaacccaagagacacggacatgtttggtcagattgctgacaataatcagaatgctacaactgctcccataaccggcaacgtgactgctatgggagtgcttcctggcatggtgtggcaaaacagagacatttactaccaagggccaatttgggccaagatcccacacgcggacggacattttcatccttcaccgctaattggcggttttggactgaaacatccgcctccccagatatttatcaaaaacacccccgtacctgccaatcctgcgacaaccttcactgcagccagagtggactctttcatcacacaatacagcaccggccaggtcgctgttcagattgaatgggaaatcgaaaaggaacgctccaaacgccggaatcctgaagtgcagtttacttcaaactatgggaaccagtcttctatgttgtgggctcccgatacaactgggaagtatacagagccgcgggttattggctctcgttatttgactaatcatttgtaactgcctagttaatcaataaaccgtgtgattcgtttcagttgaactttggtctctgcgaagggcgaattc

SEQ ID NO: 5014 - DNA, 3105 bp, Adeno-associated virus
gaattcgcccttcgcagagaccaaagttcaactgaaacgaatcacacggtttattgattaactaggcagttacaaatgattagtcaaataacgagagccaataacccgcggctctgtatacttcccagttgtatcgggagcccacaacatagaagactggttcccacagtttgaagtaaactgcacttcaggattccagcgtttggagcgttccttttcgatttcccattcaatctgaacagcgacctggccggtgctgtattgtgtgatgaaagagtccactctggctgcagtgaaggttgtcgcaggataggcaggtacgggggtgtttttgataaatatctggggaggcggatgtttcagtccaaaaccgccaattagcggtgaaggatgaaaatgtccgtccgcgtgtgggatcttggcccaaattggcccttggtagtaaatgtctctgttttgccacaccatgccaggaagcactcccatagcagtcacgttgccggttatgggagcagttgtagcattctgattattgtcagcaatctgaccaaacatgtccgtgtctcttgggttggtggcagcaatttcttcttctgatgtaaacaacagattgtttgctgaggttgttgtgtttccggtgactgatggtccagggaagatgagctgggcgttgctgaagtccccatctgaaggtccagctgttgccattggaggtccaggcgctatgttgctccagcggttgtttaaggtatagtgggtgtcatactttaacagagcgttgcccccgctggcaggaatcttgtaattttgactggcagtttttgagaatctctgctgtttaacacaaggcccaggcagccagttctttctgtaaaaggcaaagtctccactcctgatttttccaaatgtggttgctgcattgccttgattcagagtctctccagaggtggtcgactgtaagtgccacaggtactggtccaggaggggattcatcagtccgtccaggctctggctgtgagcatacattgagtggaacggcaccttctcaaagttgtaagccgtttcaaagttattgccagttctcagcatttgtgaaggaaaatactccaggcagtagaaagcatttctgtccgtctggttctgattttcgccagtcacaatgccacagtagccatattgaggcaccatgaagacgtcattggggaaaggaggcagacttccctcttgtccagcgtccatcacgtacgggagctcatacgacgagtccgcaaatatctgaaccgtgctggtaaggttattagcgaccgtagtctcgccgttcgacgttgtgacctccttaacttggatattgaagattttaacgcgcatggcttttggtcgtagtccccagttgttgttgatgagtctttgccagtcacgtggtgagaagtgacagtggaatctgttaaagtcaaagtatccccagggggtggagaatccgttgtaggtgttgctgtttgatgttgttccgagccgcaggtacaagtggttgttgtaggtgggcaagacccaggttctggtcgaggttgttgtgaccttgccctcagaccaggtggaatcgcaatgccaatcacccgaggcattacccactccatcggaaccttgtcccgcatcgacagcatttccgcccggtgctgcacgcatttcaatgtctgaagacatggcgctggtatctgatccttcagggggtccgtctccggctccagtgtcctcttcaaagttgagtctctttttggctggttgtttgccttttttgccgattcctgaggaggagtcgggctcttgtggtgactctaacggtctcttctttccaggagccgtcttagcaccttcttcaaccaggcccagaggttcgagtaccctcttcttggcctggaagactgctcgcccgaggttgcccccaaaagacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtactcgtagccaggaagcaccagaccccggccgtcgtcctgcttctgctggttggccttgggcttgggggctccaggtttcaggtcccaccactcgcgaatgccctcagagaggttgtcctcgagccaatctggaagataaccgtcagcagccatacctggtttaagtcatttattgctcagaaacacagtcatccaagtccacgttgacgagatcgcaggccgaacacgcaatctcgggtgcccgccccagcagatgatgaatcgcgcacagtttctgatacgtcttttttctgacgacgggttgagattctgacgcgccggggaagcactctgagcagtctctgaccccgtgcgtgaagcagacgttgaaattctgattcattctctcgcatgtcttgcagggaaacagcatctgaagcatgcccgcgtgacgagaacatttgttttggtacctgtccgcaaggtccaccggtgcttccgcgtctgacgtcgatggctccgcaactgaggggcaggcccgcttgggctcgcttatatccgcgtcactgggggcgggtcttttggtggctccgccctttctgacgtagaactcatgcgccacctcagtcacgtgatcctgagcccagcggaagaactctttgacttcctgcttggtcaccttgccaaagtcgtgctccagacggcgggtgagctcgaacttgaacatgcggtcctgcagcggctgctggtgctcgaaggtggtgctgttcccgtcgatcacggcgcacatgttggtgttggaggtgacgatcacgggcgtggggtcgatctgggccgatgacttgcacttttggtccacgcgcaccttgcttccgcccagaatggccttggcggactccacgaccttggcggtcatcttgccctcctcccaccagatcaccatcttgtcgacgcaatcgttgaagggaaagttctcattggtccagttgacgcagcaagggcgaattc

SEQ ID NO: 5015 - DNA, 3094 bp, Adeno-associated virus
gaattcgcccttgctgcgtcaactggaccaagagaactttcccttcaacgattgcgtcgacaagatggtgatctggtgggaggagggcaagatgacggccaaggtcgtggagtccgccaaagccattctgggcggaagcaaggtgcgcgtcgaccaaaagtgcaagtcctcggcccagatcgatcccacccccgtgatcgtcacctccaacaccaacatgtgcgccgtgatcgacgggaacagcaccaccttcgagcaccagcagccgttgcaggaccggatgttcaaatttgaactcacccgccgtctggaacacgactttggcaaggtgaccaagcaggaagtcaaagagttcttccgctgggctagtgatcacgtgactgaggtgacgcatgagttctacgtcagaaagggcggagccagcaaaagacccgcccccgatgacgcggatataagcgagcccaagcgggcctgtccctcagtcacggacccatcgacgtcagacgcggaaggagctccggtggactttgccgacaggtaccaaaacaaatgttctcgtcacgcgggcatgcttcagatgctgtttccctgcaaaacgtgcgagagaatgaatcagaatttcaacatttgcttcacgcacggggtcagagactgtttagaatgtttccccggcgtgtcagaatctcaaccggtcgtcagaaaaaagacgtatcggaagctgtgtgcgattcatcatctgctggggcgggcacccgagattgcttgctcggcctgcgacctggtcaacgtggacctggacgactgtgtttctgagcaataaatgacttaaaccgggtatggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctggaaagaagagacccatagactctccagactcctccacgggcatcggcaaaaaaggccagcagcccgctaaaaagaagctcaattttggtcagactggcgactcagagtcagtccccgaccctcaacctcttggagaacctccagcagcgccctctagtgtgggatctggtacaatggctgcaggcggtggcgcaccaatggcagacaataacgaaggtgccgacggagtgggtaatgcctcaggaaattggcattgcgattccacatggctgggcgacagagtcatcaccaccagcaccagaacctgggccctccccacctacaacaaccacctctacaagcaaatctccagcagcagctcaggagccaccaatgacaaccactacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacaacgaatgacggcgtcacgaccatcgctaataaccttaccagcacggttcaggtcttctcggactcggaataccagctgccgtacgtcctcggctctgcgcaccagggctgcctgcctccgttcccggcggacgtcttcatgattcctcagtacggctacctgactctgaacaacggcagccaatcggtgggccgttcctccttctactgcctggaatatttcccctctcaaatgctgagaacgggcaacaactttgagttcagttacagcttcgaggacgtgcctttccacagcagctacgcgcacagccagagcctagaccggctgatgaaccctctcatcgaccagtacctgtactacctggcccggacccagagcaccacgggttccaccagggaactgcaatttcatcaagctgggcccaatactatggccgagcagtcaaagaactggctgcctggaccctgctataggcaacagggactgtcaaagaacttggactttaacaacaacagcaattttgcctggactgctgccactaaatatcatctgaatggcagaaactctttgaccaatcctggcattcccatggcaaccaacaaggatgatgaggaccagttctttcccatcaacggggtactggtttttggcaagacgggagctgccaacaaaactacgctggaaaacgttctgatgaccagcgaggaggagatcaagaccactaaccctgtggctacagaagaatacggtgtggtctccagcaacctgcagccgtctacagccgggcctcaatcacagactatcaacagccagggagcactgcctggcatggtctggcagaaccgggacgtgtatctgcagggtcccatctgggccaaaattcctcacacggatggcaactttcacccgtctcctctgatgggcggttttggactcaaacacccgcctccacagatcctgatcaaaaacacacctgtacctgctaatcctccggaggtgtttactcctgccaagtttgcctccttcatcacgcagtacagcaccggacaagtcagcgtggaaatcgagtgggagctgcagaaagaaaacagcaagcgctggaacccagaaattcagtatacttccaattatgccaagtctaataatgttgaatttgctgtgaaccctgatggtgtttatactgagcctcgccccattggcactcgttacctcccccgtaatctgtaattgcttgttaatcaataaaccggttgattcgtttcagttgaactttggtctctgcgaagggcgaattc

SEQ ID NO: 5016 - DNA, 3095 bp, Adeno-associated virus
gaattcgcccttcgcagagaccaaagttcaactgaaacgaatcaaccggtttattgattaacaagcaattacagattacgggtgaggtaacgagtgccaatggggcgaggctcagtataaacaccatcagggttcacagcaaattcaacattattagacttggcataattggaagtatactgaatttctgggttccagcgcttgctgttttctttctgcagctcccactcgatttccacgctgacttgtccggtgctgtactgcgtgatgaaggaggcaaacttggcaggagtaaacacctccggaggattagcaggtacaggtgtgtttttgatcaggatctgtggaggcgggtgtttgagtccaaaaccgcccatcagaggagacgggtgaaagttgccatccgtgtgaggaattttggcccagatgggaccctgcagatacacgtcccggttctgccagaccatgccaggcagtgctccctggctgttgatagtctgtgattgaggcccggctgtagacgactgcaggttgctggagaccacaccgtattcttctgtagccacagggttagtggtcttgatctcctcctcgctggtcatcagaacgttttccagcgtagttttgttggcagctcccgtcttgccaaaaaccagtaccccgttgatgggaaagaactggtcctcatcatccttgttggttgccatgggaatgccaggattggtcaaagagtttctgccattcagatgatatttagtggcagcagtccaggcaaaattgctgttgttgttaaagtccaagttctttgacagtctctgttgcctatagcagggtccaggcagccagttctttgactgctcggccatagtattgggcccagcttgatgaaattgcagttccctggtggaacccgtggtgctctgggtccgggccaggtagtacaggtactggtcgatgagagggttcatcagccggtctaggctctggctgtgcgcgtagctgctgtggaaaggcacgtcctcgaagctgtaactgaactcaaagttgttgcccgttctcagcatttgagaggggaaatattccaggcagtagaaggaggaacggcccaccgattggctgccgttgtccagagtcaggtagccgtactgaggaatcatgaagacgtccgccgggaacggaggcaggcagccctggtgcgcagagccgaggacgtacggcagctggtattccgagtccgagaagacctgaaccgtgctggtaaggttattagcgatggtcgtgacgccgtcattcgttgtgacctccttgacctggatgttgaggagcttgaaccgcagcttcttgggccggaatccccagttgttgttgatgagtcgctgccagtcacgtggtgagaagtggcagtggaatctgttaaagtcaaaatacccccagggggtgctgtagccgaagtagtggttgtcattggtggctcctgagctgctgctggagatttgcttgtagaggtggttgttgtaggtggggagggcccaggttctggtgctggtggtgatgactctgtcgcccagccatgtggaatcgcaatgccaatttcctgaggcattacccactccgtcggcaccttcgttattgtctgccattggtgcgccaccgcctgcagccattgtaccagatcccacactagagggcgctgctggaggttctccaagaggttgagggtcggggactgactctgagtcgccagtctgaccaaaattgagcttctttttagcgggctgctggccttttttgccgatgcccgtggaggagtctggagagcctatgggtctcttctttccaggagccgtcttagcgccttcctcaaccagaccgagaggttcgagaacccgcttcttggcctggaagactgctcgcccgaggttgcccccaaatgacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggtttcggggctccaggtttcaggtcccaccactcgcgaatgccctcagagaggttgtcctcgagccaatctggaagataaccatcggcagccatacctggtttaagtcatttattgctcagaaacacagtcgtccaggtccacgttgaccaggtcgcaggccgagcaagcaatctcgggtgcccgccccagcagatgatgaatcgcacacagcttccgatacgtcttttttctgacgaccggttgagattctgacacgccggggaaacattctaaacagtctctgaccccgtgcgtgaagcaaatgttgaaattctgattcattctctcgcacgttttgcagggaaacagcacctgaagcatgcccgcgtgacgagaacatttgttttggtacctgtcggcaaagtccaccggagctccttccgcgtctgacgtcgatgggtccgtgactgagggacgggcccgcttgggctcgcttatatccgcgtcatcgggggcgggtcttttgctggctccgccctttctgacgtagaactcatgcgtcacctcagtcacgtgatcactagcccagcggaagaactctttgacttcctgctttgtcaccttgccaaagtcgtgttccagacggcgggtgagttcaaatttgaacatccggtcctgcaacggttgctggtgctcgaaggtggtgctgttcccgtcgatcacggcgcacatgttggtgttggaggtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagcaagggcgaattc

SEQ ID NO: 5017 - DNA, 3095 bp, Adeno-associated virus
gaattcgcccttcgcagagaccaaagttcaactgaaacgaatcaaccggtttattgattaacaagcaattacagattacgggtgaggtaacgagtgccaatggggcgaggctcagtataaacaccatcagggttcacagcaaattcaacattattagacttggcataattggaagtatactgaatttctgggttccagcgcttgctgttttctttctgcagctcccactcgatttccacgctgacttgtccggtgctgtactgcgtgatgaaggaggcaaacttggcaggagtaaacacctccggaggattagcaggtacaggtgtgtttttgatcaggatctgtggaggcgggtgttcgagtccaaaaccgcccatcagaggagacgggtgaaagttgccatccgtgtgaggaattttggcccagatgggaccctgcagatacacgtcccggttctgccagaccatgccaggcagtgctccctggctgttgatagtctgtgattgaggcccggctgtagacgactgcaggttgctggagaccacaccgtattcttctgtagccacagggttagtggtcttgatctcctcctcgctggtcatcagaacgttttccagcgtagttttgttggcagctcccgtcttgccaaaaaccagtaccccgttgatgggaaagaactggtcctcatcatccttgttggttgccatgggaatgccaggattggtcaaagagtttctgccattcagatgatatttagtggcagcagtccaggcaaaattgctgttgttgttaaagtccaagttctttgacagtctctgttgcctatagcagggtccaggcagccagttctttgactgctcggccatagtattgggcccagcttgatgaaattgcagttccctggtggaacccgtggtgctctgggtccgggccaggtagtacaggtactggtcgatgagagggttcatcagccggtctaggctctggctgtgcgcgtagctgctgtggaaaggcacgtcctcgaagctgtaactgaactcaaagttgttgcccgttctcagcatttgagaggggaaatattccaggcagtagaaggaggaacggcccaccgattggctgccgttgttcagagtcaggtagccgtactgaggaatcatgaagacgtccgccgggaacggaggcaggcagccctggtgcgcagagccgaggacgtacggcagctggtattccgagtccgagaagacctgaaccgtgctggtaaggttattagcgatggtcgtgacgccgtcattcgttgtgacctccttgacctggatgttgaagagcttgaaccgcagcttcttgggccggaatccccagttgttgttgatgagtcgctgccagtcacgtggtgagaagtggcagtggaatctgttaaagtcaaaatacccccagggggtgctgtagccgaagtagtggttgtcattggtggctcctgagctgctgctggagatttgcttgtagaggtggttgttgtaggtggggagggcccaggttctggtgctggtggtgatgactctgtcgcccagccatgtggaatcgcaatgccaatttcctgaggcattacccactccgtcggcaccttcgttattgtctgccgttggtgcgccaccgcctgcagccattgtaccagatcccacactagagggcgctgctggaggttctccaagaggttgagggtcggggactgactctgagtcgccagtctgaccaaaattgagcttctttttagcgggctgctggccttttttgccgatgcccgtggaggagtctggagagtctatgggtctcttctttccaggagccgtcttagcgccttcctcaaccagaccgagaggttcgagaacccgcttcttggcctggaagactgctcgcccgaggttgcccccaaatgacgtatcttcttgcaggcgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggtttcggggctccaggtttcaggtcccaccactcgcgaatgccctcagagaggttgtcctcgagccaatctggaagataaccatcggcagccatacctggtttaagccatttattgctcagaaacacagtcgtccaggtccacgttgaccaggtcgcaggccgagcaggcaatctcgggtgcccgccccagcagatgatgaatcgcacacagcttccgatacgtcttttttctgacgaccggttgagattctgacacgccggggaaacattctaaacagtctctgaccccgtgcgtgaagcaaatgttgaaattctgattcattctctcgcacgttttgcagggaaacagcatctgaagcatgcccgcgtggcgagaacatttgttttggtacctgtcggcaaagtccaccggagctccttccgcgtctgacgtcgatgggtccgtgactgagggacaggcccgcttgggctcgcttatatccgcgtcatcgggggcgggtcttttgctggctccgccctttctgacgtagaactcatgcgtcacctcagtcacgtgatcactagcccagcggaagaactctttgacttcctgctttgtcaccttgccaaagtcgtgttccagacggcgggtgagttcaaatttgaacatccggtcctgcaacggctgctggtgctcgaaggtggtgctgttcccgtcgatcacggcgcgcatgttggtgttggaggtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagcaagggcgaattc

SEQ ID NO: 5018 - protein, 729 aa, Adeno-associated virus; identical to SEQ ID NO: 4833

SEQ ID NO: 5019 - protein, 729 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPTADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 5020 - protein, 729 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPMADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 5021 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcggcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagcccttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgcactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgctacctcacccgtaatctgtaa

SEQ ID NO: 5022 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQRPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKPFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLHYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 5023 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgataacttgcagcaaaccaatacggggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 5024 - protein, 738 aa, Adeno-associated virus; identical to SEQ ID NO: 4797

SEQ ID NO: 5025 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQDEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSARAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQANTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNSEGTYSEPRPIGTRYLTRNL

SEQ ID NO: 5026 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcaggatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcgggctaagaactggctacctggaccttgctaccggcagcagcgagtctctacgacactgtcgcaaaacaacaacagcaactttgcttggactggtgccaccaaatatcacctgaacggaagagactctttggtaaatcccggtgttgctatggcaacgcataaggacgacgaggaacgtttctttccatcgagcggagtcctgatgtttggaaaacagggtgctggaagagacaatgtggactatagcagcgttatgctaaccagcgaggaagaaattaaaaccactaaccctgtagccacagaacaatacggtgtggtggctgacaacttgcagcaagccaatacagggcctattgtgggaaatgtcaacagccaaggagccttacctggcatggtctggcagaaccgagacgtgtacctgcagggtcccatctgggccaaaattcctcacacggacggcaattttcacccgtctcctctgatgggcggctttggactgaagcacccacctccccagatcctgatcaagaatacgccggtacctgcggatcctccaacgacgttcagccaggcaaaattggcttccttcatcacgcagtacagcaccggccaggtcagcgtggagatcgagtgggagctgcagaaggagaacagcaagcgatggaacccagaaattcagtacacttccaactactacaaatctacaaatgtggactttgctgtcaattctgagggtacatattcagagcctcgccccattggtactcgttatctgacacgtaatctgtaa

SEQ ID NO: 5027 - DNA, 2211 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggcctggtgcttcctggctacaagtacctcggacccttcaacggactcgacaagggggagcccgtcaacgcggcggacgcagcggccctcgagcacgacaaggcctacgaccagcagctcgaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccagtagagcagtcaccccaagaaccagactcctcctcgggcatcggcaagaaaggccaacagcccgccagaaaaagactcaattttggccagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgttttttcccagtaacgggatcctgtttttggcaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctacagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 5028 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLEAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPVTGSCFWQQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 5029 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcagcgcggcggacgcagcggccctcgagcacgacaaggcctgcgaccagcggctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagggaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggctttgcccacctacaacaatcacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacgaacagactggtgtggactttgccgttgacagccagggtgtttattctgagcctcgccccattggtactcgttacctcacccgtaatctgtaa

SEQ ID NO: 5030 - protein, 737 aa, Adeno-associated virus
MAADGYLPDWLEDNLSEGIREWWDLKPGAPKPKANQQKQDDGRGLVLPGYKYLGPFNGLDKGEPVSAADAAALEHDKACDQRLKAGDNPYLRYNHADAEFQERLQEDTSFGGNLGRAVFQAKKRVLEPLGLVEEAAKTAPGKKGPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDEQTGVDFAVDSQGVYSEPRPIGTRYLTRNL

SEQ ID NO: 5031 - DNA, 2214 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcgactcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatccttatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgcttactctgagcctcgccccattggcactcgttacctcacccgtaatctgtaa

SEQ ID NO: 5032 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSTQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGAYSEPRPIGTRYLTRNL

SEQ ID NO: 5033 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaaggccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 5034 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKATNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 5035 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagcacctcggacccttcaacggactcgacaagggggagcccgtcaacgcggcggacgcagcggccctcgagcacgacaaggcctacgaccagcagctcaaagcgggtgacaatccgtacctgcggtataatcacgctgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 5036 - protein, 738 aa, Adeno-associated virus
MAADGYLPDWLEDNLSEGIREWWDLKPGAPKPKANQQKQDDGRGLVLPGYKHLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5037 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINSNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5038 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacaagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacagcaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 5039 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINSNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5040 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5041 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5042 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgcacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacttatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggagtaccagctgccgtacgtcctcggctctgcccaccagggctgcctgcctccgttcccggcggacgtcttcatgattcctcagtacggcaacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacatgggctatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacggcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 5043 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPHLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQLIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGNLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNMGYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYGTGQVSVEIEWELQKENSKRWNPEIQYTSNYYKSTNVDFAVNTEGVYSEPRPIGTRYLTRNL

SEQ ID NO: 5044 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccggaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcgtcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggagcccagagattcagtatacttccaactactacaaatctacaaatgtggactttgctgttaatactgagggtgtttactctgagcctcgccccattggcactcgttacctcacccgtaatctgtaa

SEQ ID NO: 5045 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAGKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLVDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWSPEIQYTSNYYKSTNVDFAVNTEGVYSEPRPIGTRYLTRNL

SEQ ID NO: 5046 - DNA, 2217 bp, Adeno-associated virus
atggttgccgatggttatcttccagattggctcgaggacaacctctctgagggcattcgcgagtggtgggacctgaaacctggagccccgaaacccaaagccaaccagcaaaagcagggcgacggccggggtctggtgcttcctggctacaagtacctcggacccttcaacggactcgacaagggggagcccgtcaacgcggcggacgcagcggccctcgagcacgacaaggcctacgaccagcagcttaaagcgggtgacaatccgtacctgcggtataatcacgccgacgccgagcttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcgccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgccagcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagccgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 5047 - protein, 738 aa, Adeno-associated virus
MVADGYLPDWLEDNLSEGIREWWDLKPGAPKPKANQQKQGDGRGLVLPGYKYLGPFNGLDKGEPVNAADAAALEHDKAYDQQLKAGDNPYLRYNHADAELQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCQPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWEPQKENSKRWNPEIQYTSNYYKSTNVDFAVNTEGVYSEPRPIGTRYLTRNL

SEQ ID NO: 5048 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaatagcctcaccagcaccatccaggtgtttacggactcggaataccagctgccgtacgtcctcggctctgcccaccagggctgcctgcctccgttcccggcggacgtcttcatgattcctcagtacggctacctgactcccaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgtcttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacttgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 5049 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANSLTSTIQVFTDSEYQLPYVLGSAHQGCLPPFPADVFMIPQYGYLTPNNGSQAVGRSSFYCLEYFPSQMLRTGNNFSFSYTFEDVPFHSSYAHSQSLDRLMNPLIDQYLYYLSRTQSTGGTAGTQQLLSSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 5050 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYVHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNSGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYPTRNL

SEQ ID NO: 5051 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgtgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaattcgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttaccccacccgtaatctgtaa

SEQ ID NO: 5052 - protein, 734 aa, Adeno-associated virus; identical to SEQ ID NO: 4948

SEQ ID NO: 5053 - DNA, 2214 bp, Adeno-associated virus
atggctgctgacggttatcttccagattggctcgaggacaacctctctgagggcattcgcgagtggtgggacctgaaacctggagccccgaaacccaaagccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaacctctcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcgactcatcaacaacaactggggattccggcccaagaagctcaacttcaagctcttcaacatccaagtcaaggaggtcacgacgaatgacggcgtcacgaccatcgctaataaccttaccagcacggttcaggtcttttcggactcggagtaccagctgccgtacgtcctcggctctgcccaccagggctgcctgcctccgttcccggcggacgtcttcatgattcctcagtacggctacctgactctgaacaatggcagccaatcggtgggacgttcatccttctactgcctggaatacttcccttctcaggtgctgagaacgggtaacaacttcaccttcagttacaccttcgaggacgtgcctttccacagcagctacgcgcacagccagagcctagaccggctgatgaatcccctcatcgaccagtacctgtattacctggctagaacacagagtaacccaggaggcacatctggcaatcgggaactgcagttttaccagggcgggccttccaccatggccgaacaagccaagaactggttacctggaccttgcttccggcaacaaagagtttccaaaacactggatcaaaacaacaacagcaactttgcttggactggtgccaccaaatatcacctgaacggcagaaactcattggtgaatcctggtgtcgccatggcaactcacaaggacgacgaggaccgctttttcccatccagcggagtcctgatttttggaaaaactggagcaaccaacaagactacattggaaaacgtgttaatgacaaatgaagaagaaattcgtcctactaatcctgtggccacagaagaatacgggatagtcagcagcaatttacaagcggccaatactgcagcccagacacaagttgtcaacaaccagggagccttacctggcatggtctggcagaaccgggacgtgtacctgcagggtcccatctgggccaaaattcctcacacagacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 5054 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPLGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQVLRTGNNFTFSYTFEDVPFHSSYAHSQSLDRLMNPLIDQYLYYLARTQSNPGGTSGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5055 - DNA, 2214 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacacggctgggcgacagagtcatcaccaccagcacccggacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacgaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 5056 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTRLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQRRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5057 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcttcaggaaattggcattgcgattcccaatggctgggcgacagagtcatcaccaccagcacccgaacctgggcccagcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggagctcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtaccacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccgaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 5058 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWAQPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGALQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHRGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 5059 - DNA, 2217 bp, Adeno-associated virus
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcgccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaacctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgcggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 5060 - protein, 738 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQTSNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSAEIEWELQKENSKRWNPEIQYTSNYYKSTNVDFAVNTEGVYSEPRPIGTRYLTRNL

SEQ ID NO: 5061 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaacctccagcagcgccctctagtgtgggatctggtacaatggccgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagctgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaagcactcctgttcctgcggatcctccaacagcgttcaaccaggccaagctgaattctttcatcacgcagtacagcaccggacaagtcagcgtggagatcgagtgggagctgcagaaggagaacagcaagtgctggaacccagagattcagtatacttccaactactacaaatctacaaatgtggactttgctgttaatactgagggtgtttactctgagcctcgccccattggcactcgttacctcacccgtaatctgtaa

SEQ ID NO: 5062 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKSTPVPADPPTAFNQAKLNSFITQYSTGQVSVEIEWELQKENSKCWNPEIQYTSNYYKSTNVDFAVNTEGVYSEPRPIGTRYLTRNL

SEQ ID NO: 5063 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKSTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 5064 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccctaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 5065 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNPTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 5066 - DNA, 2208 bp, Adeno-associated virus
atggctgccgatggttatcttccagattggctcgaggacaacctctctgagggcattcacgagtggtgggacccgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacccacaacaaccacctctacaagcaaatctccaacgggacctcgggaggcagcaccaacgacaacgtctacttcggctacagcaccccctgggggtattttgacttcaacagattccactgtcacttctcaccacgtgaccggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacggaaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 5067 - protein, 735 aa, Adeno-associated virus
MAADGYLPDWLEDNLSEGIHEWWDPKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTHNNHLYKQISNGTSGGSTNDNVYFGYSTPWGYFDFNRFHCHFSPRDRQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTEGTAGTQQLLFSQAGPSNMSAQARNWLPGPCYRQQRVSTTLSQNNNSNFAWTGATKYHLNGRDSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5068 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRPINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYPFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQDTAPIVGAVNSQGALPGMVWQNRDVYLQGPIWAKIPHTDGNFHPSPLMGGFGLKHPPPQVLIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 5069 - DNA, 2217 bp, Adeno-associated virus
atggctgccgatggttatcttccagattggctcgaggacaacctctctgagggcattcgcgagtggtgggacctgaaacctggagccccgaaacccaaggccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgacccatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctaccctttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaagacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcaggtcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 5070 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagttccaggagcgtctgcaagaagatacgtcttttgggggcaacctcgggcgagcagtcttccaggccaagaagcgggttctcgaacctctcggtctggctgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagagccaccagcaggcccctctggtctgggatctggtacaatggctgcaggcggtggcgcaccaatggctgacaataacaagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgggtgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatgacagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 5071 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLAEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTGDGVTTIANNLTSTVQVFSDSEYQLPYVLGSAHQGCLPPFPADVFMIPQYGYLTLNNDSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5072 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgtgtgggagctgcagaaggagaacagcaagcgcaggaacccagagattcagtatacttccaactactacaaatctacaaatgtggactttgctgttaatactgagggtgtttactctgagcctcgccccattggcactcgttacctcacccgtaatctgtaa

SEQ ID NO: 5073 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIVWELQKENSKRRNPEIQYTSNYYKSTNVDFAVNTEGVYSEPRPIGTRYLTRNL

SEQ ID NO: 5074 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 5075 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIVWELQKENSKRWNPEIQYTSNYYKSTNVDFAVNTEGVYSEPRPIGTRYLTRNL

SEQ ID NO: 5076 - protein, 738 aa, Adeno-associated virus; identical to SEQ ID NO: 5074

SEQ ID NO: 5077 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctagaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 5078 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPRPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5079 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccatgccgacgccgagtttcaggagcgtctgcaagaagatacgtcttttgggggcaacctcgggcgagcagtcctccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 5080 - protein, 737 aa, Adeno-associated virus; identical to SEQ ID NO: 5040

SEQ ID NO: 5081 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVLQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 5082 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccacccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggtgatcgagtgggagctgcagaaggagaacagcaagcgctggaacccagagattcagtatacttccaactactacaaatctacaaatgtggactttgctgttaatactgagggtgtttactctgagcttcgccccattggcactcgttacctcacccgtaatctgtaa

SEQ ID NO: 5083 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPPSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVVIEWELQKENSKRWNPEIQYTSNYYKSTNVDFAVNTEGVYSELRPIGTRYLTRNL

SEQ ID NO: 5084 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgccccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccatcagctacaccttcgaggacgttcccttccacagcagctacgcacacagccagagcctggaccggctgatgaatcctcttatcgaccagtacctgtattacctggccagaacacagagcaacgcaggaggcacagctggcaatcaggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 5085 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTISYTFEDVPFHSSYAHSQSLDRLMNPLIDQYLYYLARTQSNAGGTAGNQELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 5086 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccgcctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggatgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgagcggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattcttccatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatttgtaa

SEQ ID NO: 5087 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPAYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLSGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSSITQYSTGQVSVEIEWELQKENSKRWNPEIQYTSNYYKSTNVDFAVNTEGVYSEPRPIGTRYLTRNL

SEQ ID NO: 5088 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5089 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 5090 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQRQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 5091 - protein, 736 aa, Adeno-associated virus
MAADGYLPDWLEDNLSEGIREWLNLKPGAPQPKANQQKQDNARGLVLPGYKYLGPFNGLDKGDPVNEADAAALEHDKAYGQQLKAGDNPYLKYNHADAEFQERLQKDTSFGGNLGKAVFQAKKRILEPLGLVETPAKTAPGKKRPVDPSPQRSPDSSSGIGKKSPHPARKRLNFGQTGEAESVPDPQPIGEPPSDPSSVGSGTMAAGGGAPMADNNEGADGVGNSSGNWHCDSTWLGDRVITTSTRTWALPTYNNHLYKQISSQSGATNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSKTQGTNATVQGAKLQFSQAGPSNMRDQARNWLPGPCYRQQRVSKTANDNNNSEYAWTGATKYHLNGRDSLVNPGPAMASHKDDEEKFFPMNGTLVFGKNGAGNSNVDIENVMITDEEEIRTTNPVATEQYGVVSDNLQSSNTRPITGDVDSQGVLPGMVWQDRDVYLQGPIWAKIPHTDGHFHPSPLMGGFGLKHPPPQILIKNTPVPANPATTFTPGKFASFITQYSTGQVSVQIEWELQKENSKRWNPEIQYTSNYNKSVNVDFTVDTNGVYSEPRPIGTRYLTRNL

SEQ ID NO: 5092 - protein, 736 aa, Adeno-associated virus; identical to SEQ ID NO: 4787

SEQ ID NO: 5093 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 5094 - DNA, 2211 bp, Adeno-associated virus 1; identical to SEQ ID NO: 4977

SEQ ID NO: 5095 - protein, 736 aa, Adeno-associated virus 1; identical to SEQ ID NO: 5088

SEQ ID NO: 5096 - DNA, 4718 bp, Adeno-associated virus 1
ttgcccactccctctctgcgcgctcgctcgctcggtggggcctgcggaccaaaggtccgcagacggcagagctctgctctgccggccccaccgagcgagcgagcgcgcagagagggagtgggcaactccatcactaggggtaatcgcgaagcgcctcccacgctgccgcgtcagcgctgacgtaaattacgtcataggggagtggtcctgtattagctgtcacgtgagtgcttttgcgacattttgcgacaccacgtggccatttagggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgagctgggtggccgagaaggaatgggagctgcccccggattctgacatggatctgaatctgattgagcaggcacccctgaccgtggccgagaagctgcagcgcgacttcctggtccaatggcgccgcgtgagtaaggccccggaggccctcttctttgttcagttcgagaagggcgagtcctacttccacctccatattctggtggagaccacgggggtcaaatccatggtgctgggccgcttcctgagtcagattagggacaagctggtgcagaccatctaccgcgggatcgagccgaccctgcccaactggttcgcggtgaccaagacgcgtaatggcgccggaggggggaacaaggtggtggacgagtgctacatccccaactacctcctgcccaagactcagcccgagctgcagtgggcgtggactaacatggaggagtatataagcgcctgtttgaacctggccgagcgcaaacggctcgtggcgcagcacctgacccacgtcagccagacccaggagcagaacaaggagaatctgaaccccaattctgacgcgcctgtcatccggtcaaaaacctccgcgcgctacatggagctggtcgggtggctggtggaccggggcatcacctccgagaagcagtggatccaggaggaccaggcctcgtacatctccttcaacgccgcttccaactcgcggtcccagatcaaggccgctctggacaatgccggcaagatcatggcgctgaccaaatccgcgcccgactacctggtaggccccgctccgcccgcggacattaaaaccaaccgcatctaccgcatcctggagctgaacggctacgaacctgcctacgccggctccgtctttctcggctgggcccagaaaaggttcgggaagcgcaacaccatctggctgtttgggccggccaccacgggcaagaccaacatcgcggaagccatcgcccacgccgtgcccttctacggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggacgagagactgttcagagtgcttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaattacgtgttaatcaataaaccggttgattcgtttcagttgaactttggtctcctgtccttcttatcttatcggttaccatggttatagcttacacattaactgcttggttgcgcttcgcgataaaagacttacgtcatcgggttacccctagtgatggagttgcccactccctctctgcgcgctcgctcgctcggtggggcctgcggaccaaaggtccgcagacggcagagctctgctctgccggccccaccgagcgagcgagcgcgcagagagggagtgggcaa

SEQ ID NO: 5097 - DNA, 255 bp, Adeno-associated virus 10
ggtaattcctccggaaattggcattgcgattccacatggctgggcgacagagtcatcaccaccagcacccgaacctgggtcctgcccacctacaacaaccacatctacaagcaaatctccagcgagacaggagccaccaacgacaaccactacttcggctacagcaccccctgggggtattttgactttaacagattccactgccacttttcaccacgtgactggcagcgactcatcaacaacaactggggattc

SEQ ID NO: 5098 - protein, 738 aa, Adeno-associated virus 10
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGESESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQANTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 5099 - protein, 738 aa, Adeno-associated virus 10; identical to SEQ ID NO: 4793

SEQ ID NO: 5100 - DNA, 258 bp, Adeno-associated virus 11
ggtaattcctccggaaattggcattgcgattccacatggctgggcgacagagtcatcaccaccagcacccgaacctgggccctgccaacctacaacaaccacctctacaaacaaatctccagcgcttcaacgggggccagcaacgacaaccactactttggctacagcaccccctgggggtattttgactttaacagattccactgccacttctcaccacgtgactggcagcgactcatcaacaacaactggggattc

SEQ ID NO: 5101 - DNA, 255 bp, Adeno-associated virus 12
ggtaattcctccggaaattggcattgcgattccacatggctgggcgaccgagtcattaccaccagcacccggacttgggccctgcccacctacaacaaccacctctacaagcaaatctccagccaatcgggtgccaccaacgacaaccactacttcggctacagcaccccttgggggtattttgatttcaacagattccactgccatttctcaccacgtgactggcagcgactcatcaacaacaactggggattc

SEQ ID NO: 5102 - DNA, 2208 bp, Adeno-associated virus 2
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 5103 - protein, 735 aa, Adeno-associated virus 2 [sequence omitted]

SEQ ID NO: 5104 - protein, 621 aa, Adeno-associated virus 2
MPGFYEIVIKVPSDLDGHLPGISDSFVNWVAEKEWELPPDSDMDLNLIEQAPLTVAEKLQRDFLTEWRRVSKAPEALFFVQFEKGESYFHMHVLVETTGVKSMVLGRFLSQIREKLIQRIYRGIEPTLPNWFAVTKTRNGAGGGNKVVDECYIPNYLLPKTQPELQWAWTNMEQYLSACLNLTERKRLVAQHLTHVSQTQEQNKENQNPNSDAPVIRSKTSARYMELVGWLVDKGITSEKQWIQEDQASYISFNAASNSRSQIKAALDNAGKIMSLTKTAPDYLVGQQPVEDISSNRIYKILELNGYDPQYAASVFLGWATKKFGKRNTIWLFGPATTGKTNIAEAIAHTVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLDHDFGKVTKQEVKDFFRWAKDHVVEVEHEFYVKKGGAKKRPAPSDADISEPKRVRESVAQPSTSDAEASINYADRYQNKCSRHVGMNLMLFPCRQCERMNQNSNICFTHGQKDCLECFPVSESQPVSVVKKAYQKLCYIHHIMGKVPDACTACDLVNVDLDDCIFEQ

SEQ ID NO: 5105 - DNA, 4675 bp, Adeno-associated virus 2
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagccgccatgccggggttttacgagattgtgattaaggtccccagcgaccttgacgggcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgtacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctccggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccggccatggcaagccacaaggacgatgaagaaaagttttttcctcagagcggggttctcatctttgggaagcaaggctcagagaaaacaaatgtgaacattgaaaaggtcatgattacagacgaagaggaaatcggaacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacacggtcagcgtggagatcgagtgggagctgcagaaggaaaacagcaaacgctggaatcccgaaattcagtacacttccaactacaacaagtctgttaatcgtggacttaccgtggatactaatggcgtgtattcagagcctcgccccattggcaccagatacctgactcgtaatctgtaattgcttgttaatcaataaaccgtttaattcgtttcagttgaactttggtctctgcgtatttctttcttatctagtttccatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggccaa

SEQ ID NO: 5106 - DNA, 4679 bp, Adeno-associated virus 2
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagccgccatgccggggttttacgagattgtgattaaggtccccagcgaccttgacgggcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctccggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaattgcttgttaatcaataaaccgtttaattcgtttcagttgaactttggtctctgcgtatttctttcttatctagtttccatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggccaa

SEQ ID NO: 5107 - protein, 735 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQDKALLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 5108 - protein, 740 aa, Adeno-associated virus 2
MAADGYLPDWLEDTLSEGIRQWWKLKPGPPPPKPAERHKDDSRGLVLPGYKYLGPFNGLDKGEPVNAADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNLLLAAA

SEQ ID NO: 5109 - protein, 734 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATMYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSINVDFTVDTNGVYSEPRPIGTRYLTRN

SEQ ID NO: 5110 - protein, 734 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSEAKFASFITQYSTGQVSVEIEWELQKENSKRWNPEIQYTSNYNKSVNVDFTVDTNGVYSEPRPIGTRYLTRN

SEQ ID NO: 5111 - protein, 739 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNLLLAA

SEQ ID NO: 5112 - protein, 725 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRP

SEQ ID NO: 5113 - protein, 707 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSCIYQPPERQQTSSYRRCQHTRRSSRHGLAGQRCVPSGAHLGKDSTHGRTFSPLSPHGWIRTTPSSTDSHQEHPGTCESFDHLQCGKVCFLHHTVLHGTGQRGDRVRAAEGKQQTLESRNSVHFQLQQVC

SEQ ID NO: 5114 - protein, 739 aa, Adeno-associated virus 2; identical to SEQ ID NO: 5111

SEQ ID NO: 5115 - protein, 737 aa, Adeno-associated virus 2
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHHPPQILIKNTPVPANPSTTFSAAKFASFITQYSTGQVSVEIEWELQKENSKRWNPEIQYTSNYNKSVNVDFTVDTNGVYSEPRPIGTRYLTRNLL

SEQ ID NO: 5116 - protein, 741 aa, Adeno-associated virus 2
MAADGYLPDWLEDTLSEGIREWWALKPGAPKPKANQQKQDDGRGLVLPGYKYLGPFNGLDKGEPVNEADAAALEHDKAYDQQLQAGDNPYLRYNHADAEFQERLQEDTSFGGNLGRAVFQAKKRVLEPLGLVEEPVKTAPGKKRPVEHSPVEPDSSSGTGKSGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNLANHNNTTNARQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSINVDFTVDTNGVYSEPRPIGTRYL

SEQ ID NO: 5117 - protein, 730 aa, Adeno-associated virus 2
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTR

SEQ ID NO: 5118 - protein, 735 aa, Adeno-associated virus 2
  MOD_RES (239)..(239): Any amino acid
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRXITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 5119 - protein, 733 aa, Adeno-associated virus 2
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFLAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLT

SEQ ID NO: 5120 - protein, 734 aa, Adeno-associated virus 2
MAADGYLPDWLEDTLSEGIRQWWKLKPGPPPPKPAERHKDDSRGLVLPGCKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFSDSEYQLPYVLGSAHQGCLPPFPADVFMIPQYGYLTLNNGSQAVGRSSFYCLEYFPSQMLRTGNNFTFNYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 5121 - protein, 734 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALSTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSINVDFTVDTNGVYSEPRPIGTRYLTRN

SEQ ID NO: 5122 - protein, 738 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDGGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNLLRP

SEQ ID NO: 5123 - protein, 736 aa, Adeno-associated virus 3; identical to SEQ ID NO: 4757

SEQ ID NO: 5124 - DNA, 4726 bp, Adeno-associated virus 3
ttggccactccctctatgcgcactcgctcgctcggtggggcctggcgaccaaaggtcgccagacggacgtgctttgcacgtccggccccaccgagcgagcgagtgcgcatagagggagtggccaactccatcactagaggtatggcagtgacgtaacgcgaagcgcgcgaagcgagaccacgcctaccagctgcgtcagcagtcaggtgacccttttgcgacagtttgcgacaccacgtggccgctgagggtatatattctcgagtgagcgaaccaggagctccattttgaccgcgaaatttgaacgagcagcagccatgccggggttctacgagattgtcctgaaggtcccgagtgacctggacgagcgcctgccgggcatttctaactcgtttgttaactgggtggccgagaaggaatgggacgtgccgccggattctgacatggatccgaatctgattgagcaggcacccctgaccgtggccgaaaagcttcagcgcgagttcctggtggagtggcgccgcgtgagtaaggccccggaggccctcttttttgtccagttcgaaaagggggagacctacttccacctgcacgtgctgattgagaccatcggggtcaaatccatggtggtcggccgctacgtgagccagattaaagagaagctggtgacccgcatctaccgcggggtcgagccgcagcttccgaactggttcgcggtgaccaaaacgcgaaatggcgccgggggcgggaacaaggtggtggacgactgctacatccccaactacctgctccccaagacccagcccgagctccagtgggcgtggactaacatggaccagtatttaagcgcctgtttgaatctcgcggagcgtaaacggctggtggcgcagcatctgacgcacgtgtcgcagacgcaggagcagaacaaagagaatcagaaccccaattctgacgcgccggtcatcaggtcaaaaacctcagccaggtacatggagctggtcgggtggctggtggaccgcgggatcacgtcagaaaagcaatggattcaggaggaccaggcctcgtacatctccttcaacgccgcctccaactcgcggtcccagatcaaggccgcgctggacaatgcctccaagatcatgagcctgacaaagacggctccggactacctggtgggcagcaacccgccggaggacattaccaaaaatcggatctaccaaatcctggagctgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtaaactggaccaatgagaactttcccttcaacgattgcgtcgacaagatggtgatctggtgggaggagggcaagatgacggccaaggtcgtggagagcgccaaggccattctgggcggaagcaaggtgcgcgtggaccaaaagtgcaagtcatcggcccagatcgaacccactcccgtgatcgtcacctccaacaccaacatgtgcgccgtgattgacgggaacagcaccaccttcgagcatcagcagccgctgcaggaccggatgtttgaatttgaacttacccgccgtttggaccatgactttgggaaggtcaccaaacaggaagtaaaggactttttccggtgggcttccgatcacgtgactgacgtggctcatgagttctacgtcagaaagggtggagctaagaaacgccccgcctccaatgacgcggatgtaagcgagccaaaacgggagtgcacgtcacttgcgcagccgacaacgtcagacgcggaagcaccggcggactacgcggacaggtaccaaaacaaatgttctcgtcacgtgggcatgaatctgatgctttttccctgtaaaacatgcgagagaatgaatcaaatttccaatgtctgttttacgcatggtcaaagagactgtggggaatgcttccctggaatgtcagaatctcaacccgtttctgtcgtcaaaaagaagacttatcagaaactgtgtccaattcatcatatcctgggaagggcacccgagattgcctgttcggcctgcgatttggccaatgtggacttggatgactgtgtttctgagcaataaatgacttaaaccaggtatggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtgaatcctggttaatcaataaaccgtttaattcgtttcagttgaactttggctcttgtgcacttctttatctttatcttgtttccatggctactgcgtagataagcagcggcctgcggcgcttgcgcttcgcggtttacaactgctggttaatatttaactctcgccatacctctagtgatggagttggccactccctctatgcgcactcgctcgctcggtggggcctggcgaccaaaggtcgccagacggacgtgctttgcacgtccggccccaccgagcgagcgagtgcgcatagagggagtggccaa

SEQ ID NO: 5125 - protein, 736 aa, Adeno-associated virus 3A; identical to SEQ ID NO: 4757

SEQ ID NO: 5126 - protein, 624 aa, Adeno-associated virus 3A
MPGFYEIVLKVPSDLDERLPGISNSFVNWVAEKEWDVPPDSDMDPNLIEQAPLTVAEKLQREFLVEWRRVSKAPEALFFVQFEKGETYFHLHVLIETIGVKSMVVGRYVSQIKEKLVTRIYRGVEPQLPNWFAVTKTRNGAGGGNKVVDDCYIPNYLLPKTQPELQWAWTNMDQYLSACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGSNPPEDITKNRIYQILELNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIEPTPVIVTSNTNMCAVIDGNSTTFEHQQPLQDRMFEFELTRRLDHDFGKVTKQEVKDFFRWASDHVTDVAHEFYVRKGGAKKRPASNDADVSEPKRECTSLAQPTTSDAEAPADYADRYQNKCSRHVGMNLMLFPCKTCERMNQISNVCFTHGQRDCGECFPGMSESQPVSVVKKKTYQKLCPIHHILGRAPEIACSACDLANVDLDDCVSEQ

SEQ ID NO: 5127 - protein, 736 aa, Adeno-associated virus 3B
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 5128 - protein, 624 aa, Adeno-associated virus 3B
MPGFYEIVLKVPSDLDEHLPGISNSFVNWVAEKEWELPPDSDMDPNLIEQAPLTVAEKLQREFLVEWRRVSKAPEALFFVQFEKGETYFHLHVLIETIGVKSMVVGRYVSQIKEKLVTRIYRGVEPQLPNWFAVTKTRNGAGGGNKVVDDCYIPNYLLPKTQPELQWAWTNMDQYLSACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGSNPPEDITKNRIYQILELNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIEPTPVIVTSNTNMCAVIDGNSTTFEHQQPLQDRMFKFELTRRLDHDFGKVTKQEVKDFFRWASDHVTDVAHEFYVRKGGAKKRPASNDADVSEPKRQCTSLAQPTTSDAEAPADYADRYQNKCSRHVGMNLMLFPCKTCERMNQISNVCFTHGQRDCGECFPGMSESQPVSVVKKKTYQKLCPIHHILGRAPEIACSACDLANVDLDDCVSEQ

SEQ ID NO: 5129 - DNA, 4722 bp, Adeno-associated virus 3B
tggccactccctctatgcgcactcgctcgctcggtggggcctggcgaccaaaggtcgccagacggacgtgctttgcacgtccggccccaccgagcgagcgagtgcgcatagagggagtggccaactccatcactagaggtatggcagtgacgtaacgcgaagcgcgcgaagcgagaccacgcctaccagctgcgtcagcagtcaggtgacccttttgcgacagtttgcgacaccacgtggccgctgagggtatatattctcgagtgagcgaaccaggagctccattttgaccgcgaaatttgaacgagcagcagccatgccggggttctacgagattgtcctgaaggtcccgagtgacctggacgagcacctgccgggcatttctaactcgtttgttaactgggtggccgagaaggaatgggagctgccgccggattctgacatggatccgaatctgattgagcaggcacccctgaccgtggccgaaaagcttcagcgcgagttcctggtggagtggcgccgcgtgagtaaggccccggaggccctcttttttgtccagttcgaaaagggggagacctacttccacctgcacgtgctgattgagaccatcggggtcaaatccatggtggtcggccgctacgtgagccagattaaagagaagctggtgacccgcatctaccgcggggtcgagccgcagcttccgaactggttcgcggtgaccaaaacgcgaaatggcgccgggggcgggaacaaggtggtggacgactgctacatccccaactacctgctccccaagacccagcccgagctccagtgggcgtggactaacatggaccagtatttaagcgcctgtttgaatctcgcggagcgtaaacggctggtggcgcagcatctgacgcacgtgtcgcagacgcaggagcagaacaaagagaatcagaaccccaattctgacgcgccggtcatcaggtcaaaaacctcagccaggtacatggagctggtcgggtggctggtggaccgcgggatcacgtcagaaaagcaatggattcaggaggaccaggcctcgtacatctccttcaacgccgcctccaactcgcggtcccagatcaaggccgcgctggacaatgcctccaagatcatgagcctgacaaagacggctccggactacctggtgggcagcaacccgccggaggacattaccaaaaatcggatctaccaaatcctggagctgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtaaactggaccaatgagaactttcccttcaacgattgcgtcgacaagatggtgatctggtgggaggagggcaagatgacggccaaggtcgtggagagcgccaaggccattctgggcggaagcaaggtgcgcgtggaccaaaagtgcaagtcatcggcccagatcgaacccactcccgtgatcgtcacctccaacaccaacatgtgcgccgtgattgacgggaacagcaccaccttcgagcatcagcagccgctgcaggaccggatgtttaaatttgaacttacccgccgtttggaccatgactttgggaaggtcaccaaacaggaagtaaaggactttttccggtgggcttccgatcacgtgactgacgtggctcatgagttctacgtcagaaagggtggagctaagaaacgccccgcctccaatgacgcggatgtaagcgagccaaaacggcagtgcacgtcacttgcgcagccgacaacgtcagacgcggaagcaccggcggactacgcggacaggtaccaaaacaaatgttctcgtcacgtgggcatgaatctgatgctttttccctgtaaaacatgcgagagaatgaatcaaatttccaatgtctgttttacgcatggtcaaagagactgtggggaatgcttccctggaatgtcagaatctcaacccgtttctgtcgtcaaaaagaagacttatcagaaactgtgtccaattcatcatatcctgggaagggcacccgagattgcctgttcggcctgcgatttggccaatgtggacttggatgactgtgtttctgagcaataaatgacttaaaccaggtatggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaatcctggttaatcaataaaccgtttaattcgtttcagttgaactttggctcttgtgcacttcttatcttatcttgtttccatggctactgcgtagataagcagcggcctgcggcgcttgcgcttcgcggtttacaactgctggttaatatttaactctcgccatacctctagtgatggagttggccactccctctatgcgcactcgctcgctcggtggggccggacgtgcaaagcacgtccgtctggcgacctttggtcgccaggccccaccgagcgagcgagtgcgcatagagggagtggccaa

SEQ ID NO: 5130 - DNA, 1800 bp, Adeno-associated virus 4
  modified_base (342)..(342): a, c, t or g
acggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaataa

SEQ ID NO: 5131 - DNA, 2208 bp, Adeno-associated virus 4
  modified_base (750)..(750): a, c, t or g
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaataa

SEQ ID NO: 5132 - DNA, 1872 bp, Adeno-associated virus 4
atgccggggttctacgagatcgtgctgaaggtgcccagcgacctggacgagcacctgcccggcatttctgactcttttgtgagctgggtggccgagaaggaatgggagctgccgccggattctgacatggacttgaatctgattgagcaggcacccctgaccgtggccgaaaagctgcaacgcgagttcctggtcgagtggcgccgcgtgagtaaggccccggaggccctcttctttgtccagttcgagaagggggacagctacttccacctgcacatcctggtggagaccgtgggcgtcaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaacatggaccagtatataagcgcctgtttgaatctcgcggagcgtaaacggctggtggcgcagcatctgacgcacgtgtcgcagacgcaggagcagaacaaggaaaaccagaaccccaattctgacgcgccggtcatcaggtcaaaaacctccgccaggtacatggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggtatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacgtatcagaaactgtgtccgattcatcacatcatggggagggcgcccgaggtggcctgctcggcctgcgaactggccaatgtggacttggatgactgtgacatggaacaataa

SEQ ID NO: 5133 - DNA, 1611 bp, Adeno-associated virus 4
atgccggggttctacgagatcgtgctgaaggtgcccagcgacctggacgagcacctgcccggcatttctgactcttttgtgagctgggtggccgagaaggaatgggagctgccgccggattctgacatggacttgaatctgattgagcaggcacccctgaccgtggccgaaaagctgcaacgcgagttcctggtcgagtggcgccgcgtgagtaaggccccggaggccctcttctttgtccagttcgagaagggggacagctacttccacctgcacatcctggtggagaccgtgggcgtcaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaacatggaccagtatataagcgcctgtttgaatctcgcggagcgtaaacggctggtggcgcagcatctgacgcacgtgtcgcagacgcaggagcagaacaaggaaaaccagaaccccaattctgacgcgccggtcatcaggtcaaaaacctccgccaggtacatggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacagattggctagaggacaacctctctga

SEQ ID NO: 5134 - DNA, 1872 bp, Adeno-associated virus 4; identical to SEQ ID NO: 5132

SEQ ID NO: 5135 - DNA, 1617 bp, Adeno-associated virus 4
  modified_base (162)..(162): a, c, t or g
atgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 5136 - DNA, 939 bp, Adeno-associated virus 4
atggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacagattggctagaggacaacctctctga

SEQ ID NO: 5137 - DNA, 1197 bp, Adeno-associated virus 4
atggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggtatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacgtatcagaaactgtgtccgattcatcacatcatggggagggcgcccgaggtggcctgctcggcctgcgaactggccaatgtggacttggatgactgtgacatggaacaa

SEQ ID NO: 5138 - DNA, 245 bp, Adeno-associated virus 4
ctccatcatctaggtttgcccactgacgtcaatgtgacgtcctagggttagggaggtccctgtattagcagtcacgtgagtgtcgtatttcgcggagcgtagcggagcgcataccaagctgccacgtcacagccacgtggtccgtttgcgacagtttgcgacaccatgtggtcaggagggtatataaccgcgagtgagccagcgaggagctccattttgcccgcgaattttgaacgagcagcagc

SEQ ID NO: 5139 - protein, 313 aa, Adeno-associated virus 4
  MOD_RES (313)..(313): Any amino acid
MELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRLARGQPLX

SEQ ID NO: 5140 - protein, 399 aa, Adeno-associated virus 4
MELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRYQNKCSRHVGMNLMLFPCRQCERMNQNVDICFTHGVMDCAECFPVSESQPVSVVRKRTYQKLCPIHHIMGRAPEVACSACELANVDLDDCDMEQ

SEQ ID NO: 5141 - protein, 623 aa, Adeno-associated virus 4
MPGFYEIVLKVPSDLDEHLPGISDSFVSWVAEKEWELPPDSDMDLNLIEQAPLTVAEKLQREFLVEWRRVSKAPEALFFVQFEKGDSYFHLHILVETVGVKSMVVGRYVSQIKEKLVTRIYRGVEPQLPNWFAVTKTRNGAGGGNKVVDDCYIPNYLLPKTQPELQWAWTNMDQYISACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRYQNKCSRHVGMNLMLFPCRQCERMNQNVDICFTHGVMDCAECFPVSESQPVSVVRKRTYQKLCPIHHIMGRAPEVACSACELANVDLDDCDMEQ

SEQ ID NO: 5142 - protein, 537 aa, Adeno-associated virus 4
  MOD_RES (537)..(537): Any amino acid
MPGFYEIVLKVPSDLDEHLPGISDSFVSWVAEKEWELPPDSDMDLNLIEQAPLTVAEKLQREFLVEWRRVSKAPEALFFVQFEKGDSYFHLHILVETVGVKSMVVGRYVSQIKEKLVTRIYRGVEPQLPNWFAVTKTRNGAGGGNKVVDDCYIPNYLLPKTQPELQWAWTNMDQYISACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRLARGQPLX

SEQ ID NO: 5143 - protein, 623 aa, Adeno-associated virus 4; identical to SEQ ID NO: 5141

SEQ ID NO: 5144 - protein, 544 aa, Adeno-associated virus 4
MSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 5145 - protein, 734 aa, Adeno-associated virus 4; identical to SEQ ID NO: 4791

SEQ ID NO: 5146 - protein, 598 aa, Adeno-associated virus 4
TAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 5147 - DNA, 129 bp, Adeno-associated virus 4
ttggccactccctctatgcgcgctcgctcactcactcggccctgcggccagaggccggcagtctggagacctttggtgtccagggcagggccgagtgagtgagcgagcgcgcatagagggagtggccaa

SEQ ID NO: 5148 - DNA, 125 bp, Adeno-associated virus 4
ttggccactccctctatgcgcgctcgctcactcactcggccctggagaccaaaggtctccagactgccggcctctggccggcagggccgagtgagtgagcgagcgcgcatagagggagtggccaa

SEQ ID NO: 5149 - DNA, 4768 bp, Adeno-associated virus 4
  modified_base (3009)..(3009): a, c, t or g
ttggccactccctctatgcgcgctcgctcactcactcggccctggagaccaaaggtctccagactgccggcctctggccggcagggccgagtgagtgagcgagcgcgcatagagggagtggccaactccatcatctaggtttgcccactgacgtcaatgtgacgtcctagggttagggaggtccctgtattagcagtcacgtgagtgtcgtatttcgcggagcgtagcggagcgcataccaagctgccacgtcacagccacgtggtccgtttgcgacagtttgcgacaccatgtggtcaggagggtatataaccgcgagtgagccagcgaggagctccattttgcccgcgaattttgaacgagcagcagccatgccggggttctacgagatcgtgctgaaggtgcccagcgacctggacgagcacctgcccggcatttctgactcttttgtgagctgggtggccgagaaggaatgggagctgccgccggattctgacatggacttgaatctgattgagcaggcacccctgaccgtggccgaaaagctgcaacgcgagttcctggtcgagtggcgccgcgtgagtaaggccccggaggccctcttctttgtccagttcgagaagggggacagctacttccacctgcacatcctggtggagaccgtgggcgtcaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaacatggaccagtatataagcgcctgtttgaatctcgcggagcgtaaacggctggtggcgcagcatctgacgcacgtgtcgcagacgcaggagcagaacaaggaaaaccagaaccccaattctgacgcgccggtcatcaggtcaaaaacctccgccaggtacatggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggtatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacgtatcagaaactgtgtccgattcatcacatcatggggagggcgcccgaggtggcctgctcggcctgcgaactggccaatgtggacttggatgactgtgacatggaacaataaatgactcaaaccagatatgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacaccgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaataacctgttaatcaataaaccggtttattcgtttcagttgaactttggtctccgtgtccttcttatcttatctcgtttccatggctactgcgtacataagcagcggcctgcggcgcttgcgcttcgcggtttacaactgccggttaatcagtaacttctggcaaaccatgatgatggagttggccactccctctatgcgcgctcgctcactcactcggccctggagaccaaaggtctccagactgccggcctctggccggcagggccgagtgagtgagcgagcgcgcatagagggagtggccaa

SEQ ID NO: 5150 - protein, 725 aa, Adeno-associated virus 5
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPTTGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 5151 - protein, 724 aa, Adeno-associated virus 5
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 5152 - DNA, 2175 bp, Adeno-associated virus 5
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 5153 - DNA, 2208 bp, Adeno-associated virus 6
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctg

SEQ ID NO: 5154 - protein, 736 aa, Adeno-associated virus 6; identical to SEQ ID NO: 4799

SEQ ID NO: 5155 - protein, 623 aa, Adeno-associated virus 6
MPGFYEIVIKVPSDLDEHLPGISDSFVNWVAEKEWELPPDSDMDLNLIEQAPLTVAEKLQRDFLVQWRRVSKAPEALFFVQFEKGESYFHLHILVETTGVKSMVLGRFLSQIRDKLVQTIYRGIEPTLPNWFAVTKTRNGAGGGNKVVDECYIPNYLLPKTQPELQWAWTNMEEYISACLNLAERKRLVAHDLTHVSQTQEQNKENLNPNSDAPVIRSKTSARYMELVGWLVDRGITSEKQWIQEDQASYISFNAASNSRSQIKAALDNAGKIMALTKSAPDYLVGPAPPADIKTNRIYRILELNGYDPAYAGSVFLGWAQKRFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLEHDFGKVTKQEVKEFFRWAQDHVTEVAHEFYVRKGGANKRPAPDDADKSEPKRACPSVADPSTSDAEGAPVDFADRYQNKCSRHAGMLQMLFPCKTCERMNQNFNICFTHGTRDCSECFPGVSESQPVVRKRTYRKLCAIHHLLGRAPEIACSACDLVNVDLDDCVSEQ

SEQ ID NO: 5156 - DNA, 4683 bp, Adeno-associated virus 6
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagcgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgacttcctggtccagtggcgccgcgtgagtaaggccccggaggccctcttctttgttcagttcgagaagggcgagtcctacttccacctccatattctggtggagaccacgggggtcaaatccatggtgctgggccgcttcctgagtcagattagggacaagctggtgcagaccatctaccgcgggatcgagccgaccctgcccaactggttcgcggtgaccaagacgcgtaatggcgccggaggggggaacaaggtggtggacgagtgctacatccccaactacctcctgcccaagactcagcccgagctgcagtgggcgtggactaacatggaggagtatataagcgcgtgtttaaacctggccgagcgcaaacggctcgtggcgcacgacctgacccacgtcagccagacccaggagcagaacaaggagaatctgaaccccaattctgacgcgcctgtcatccggtcaaaaacctccgcacgctacatggagctggtcgggtggctggtggaccggggcatcacctccgagaagcagtggatccaggaggaccaggcctcgtacatctccttcaacgccgcctccaactcgcggtcccagatcaaggccgctctggacaatgccggcaagatcatggcgctgaccaaatccgcgcccgactacctggtaggccccgctccgcccgccgacattaaaaccaaccgcatttaccgcatcctggagctgaacggctacgaccctgcctacgccggctccgtctttctcggctgggcccagaaaaggttcggaaaacgcaacaccatctggctgtttgggccggccaccacgggcaagaccaacatcgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggatctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttaattcgtgtcagttgaactttggtctcatgtcgttattatcttatctggtcaccatagcaaccggttacacattaactgcttagttgcgcttcgcgaatacccctagtgatggagttgcccactccctctatgcgcgctcgctcgctcggtggggccggcagagcagagctctgccgtctgcggacctttggtccgcaggccccaccgagcgagcgagcgcgcatagagggagtgggcaa

SEQ ID NO: 5157 - DNA, 2211 bp, Adeno-associated virus 6
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 5158 - DNA, 2214 bp, Adeno-associated virus 7
atggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctgcaaagaagagaccggtagagccgtcacctcagcgttcccccgactcctccacgggcatcggcaagaaaggccagcagcccgccagaaagagactcaatttcggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacagcttcgaggacgtgcctttccacagcagctacgcacacagccagagcctggaccggctgatgaatcccctcatcgaccagtacttgtactacctggccagaacacagagtaacccaggaggcacagctggcaatcgggaactgcagttttaccagggcgggccttcaactatggccgaacaagccaagaattggttacctggaccttgcttccggcaacaaagagtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcaactaacaaaactacattggaaaatgtgttaatgacaaatgaagaagaaattcgtcctactaatcctgtagccacggaagaatacgggatagtcagcagcaacttacaagcggctaatactgcagcccagacacaagttgtcaacaaccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctggaacccggagattcagtacacctccaactttgaaaagcagactggtgtggactttgccgttgacagccagggtgtttactctgagcctcgccctattggcactcgttacctcacccgtaatctgtaa

SEQ ID NO: 5159 - protein, 738 aa, Adeno-associated virus 7
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 5160 - protein, 737 aa, Adeno-associated virus 7
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSNPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFEKQTGVDFAVDSQGVYSEPRPIGTRYLTRNL

SEQ ID NO: 5161 - protein, 623 aa, Adeno-associated virus 7
MPGFYEIVIKVPSDLDEHLPGISDSFVNWVAEKEWELPPDSDMDLNLIEQAPLTVAEKLQRDFLVQWRRVSKAPEALFFVQFEKGESYFHLHVLVETTGVKSMVLGRFLSQIREKLVQTIYRGVEPTLPNWFAVTKTRNGAGGGNKVVDECYIPNYLLPKTQPELQWAWTNMEEYISACLNLAERKRLVAQHLTHVSQTQEQNKENLNPNSDAPVIRSKTSARYMELVGWLVDRGITSEKQWIQEDQASYISFNAASNSRSQIKAALDNAGKIMALTKSAPDYLVGPSLPADIKTNRIYRILELNGYDPAYAGSVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLEHDFGKVTKQEVKEFFRWASDHVTEVAHEFYVRKGGASKRPAPDDADISEPKRACPSVADPSTSDAEGAPVDFADRYQNKCSRHAGMIQMLFPCKTCERMNQNFNICFTHGVRDCLECFPGVSESQPVVRKKTYRKLCAIHHLLGRAPEIACSACDLVNVDLDDCVSEQ

SEQ ID NO: 5162 - DNA, 4721 bp, Adeno-associated virus 7
ttggccactccctctatgcgcgctcgctcgctcggtggggcctgcggaccaaaggtccgcagacggcagagctctgctctgccggccccaccgagcgagcgagcgcgcatagagggagtggccaactccatcactaggggtaccgcgaagcgcctcccacgctgccgcgtcagcgctgacgtaaatcacgtcataggggagtggtcctgtattagctgtcacgtgagtgcttttgcgacattttgcgacaccacgtggccatttgaggtatatatggccgagtgagcgagcaggatctccattttgaccgcgaaatttgaacgagcagcagccatgccgggtttctacgagatcgtgatcaaggtgccgagcgacctggacgagcacctgccgggcatttctgactcgtttgtgaactgggtggccgagaaggaatgggagctgcccccggattctgacatggatctgaatctgatcgagcaggcacccctgaccgtggccgagaagctgcagcgcgacttcctggtccaatggcgccgcgtgagtaaggccccggaggccctgttctttgttcagttcgagaagggcgagagctacttccaccttcacgttctggtggagaccacgggggtcaagtccatggtgctaggccgcttcctgagtcagattcgggagaagctggtccagaccatctaccgcggggtcgagcccacgctgcccaactggttcgcggtgaccaagacgcgtaatggcgccggcggggggaacaaggtggtggacgagtgctacatccccaactacctcctgcccaagacccagcccgagctgcagtgggcgtggactaacatggaggagtatataagcgcgtgtttgaacctggccgaacgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtggggccctcgctgcccgcggacattaaaaccaaccgcatctaccgcatcctggagctgaacgggtacgatcctgcctacgccggctccgtctttctcggctgggcccagaaaaagttcgggaagcgcaacaccatctggctgtttgggcccgccaccaccggcaagaccaacattgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcacgactttggcaaggtgacgaagcaggaagtcaaagagttcttccgctgggccagtgatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgattcagatgctgtttccctgcaaaacgtgcgagagaatgaatcagaatttcaacatttgcttcacacacggggtcagagactgtttagagtgtttccccggcgtgtcagaatctcaaccggtcgtcagaaaaaagacgtatcggaaactctgcgcgattcatcatctgctggggcgggcgcccgagattgcttgctcggcctgcgacctggtcaacgtggacctggacgactgcgtttctgagcaataaatgacttaaaccaggtatggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctgcaaagaagagaccggtagagccgtcacctcagcgttcccccgactcctccacgggcatcggcaagaaaggccagcagcccgccagaaagagactcaatttcggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacagcttcgaggacgtgcctttccacagcagctacgcacacagccagagcctggaccggctgatgaatcccctcatcgaccagtacttgtactacctggccagaacacagagtaacccaggaggcacagctggcaatcgggaactgcagttttaccagggcgggccttcaactatggccgaacaagccaagaattggttacctggaccttgcttccggcaacaaagagtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcaactaacaaaactacattggaaaatgtgttaatgacaaatgaagaagaaattcgtcctactaatcctgtagccacggaagaatacgggatagtcagcagcaacttacaagcggctaatactgcagcccagacacaagttgtcaacaaccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctggaacccggagattcagtacacctccaactttgaaaagcagactggtgtggactttgccgttgacagccagggtgtttactctgagcctcgccctattggcactcgttacctcacccgtaatctgtaattgcatgttaatcaataaaccggttgattcgtttcagttgaactttggtctcctgtgcttcttatcttatcggtttccatagcaactggttacacattaactgcttgggtgcgcttcacgataagaacactgacgtcaccgcggtacccctagtgatggagttggccactccctctatgcgcgctcgctcgctcggtggggcctgcggaccaaaggtccgcagacggcagagctctgctctgccggccccaccgagcgagcgagcgcgcatagagggagtggccaa

SEQ ID NO: 5163 - DNA, 2214 bp, Adeno-associated virus 7; identical to SEQ ID NO: 5158

SEQ ID NO: 5164 - protein, 737 aa, Adeno-associated virus 7; identical to SEQ ID NO: 5160

SEQ ID NO: 5165 - DNA, 2217 bp, Adeno-associated virus 8
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 5166 - DNA, 2213 bp, Adeno-associated virus 8
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgtaatacagaaggcgtgtactctgaaccccgccccattggcacccgttacctcacccgtaatctg

SEQ ID NO: 5167 - DNA, 4393 bp, Adeno-associated virus 8
cagagagggagtggccaactccatcactaggggtagcgcgaagcgcctcccacgctgccgcgtcagcgctgacgtaaattacgtcataggggagtggtcctgtattagctgtcacgtgagtgcttttgcggcattttgcgacaccacgtggccatttgaggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgaactgggtggccgagaaggaatgggagctgcccccggattctgacatggatcggaatctgatcgagcaggcacccctgaccgtggccgagaagctgcagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggaaaagcttggtccagaccatctacccgcggggtcgagccccaccttgcccaactggttcgcggtgaccaaagacgcggtaatggcgccggcgggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctatatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtggggccctcgctgcccgcggacattacccagaaccgcatctaccgcatcctcgctctcaacggctacgaccctgcctacgccggctccgtctttctcggctgggctcagaaaaagttcgggaaacgcaacaccatctggctgtttggacccgccaccaccggcaagaccaacattgcggaagccatcgcccacgccgtgcccttctacggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaattgcctgttaatcaataaaccggttgattcgtttcagttgaactttggtctctgcg

SEQ ID NO: 5168 - protein, 738 aa, Adeno-associated virus 8; identical to SEQ ID NO: 5159

SEQ ID NO: 5169 - protein, 737 aa, Adeno-associated virus 8
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVIQKACTLNPAPLAPVTSPVI

SEQ ID NO: 5170 - DNA, 2217 bp, Adeno-associated virus 8; identical to SEQ ID NO: 5165

SEQ ID NO: 5171 - DNA, 4385 bp, Adeno-associated virus 9
cagagagggagtggccaactccatcactaggggtaatcgcgaagcgcctcccacgctgccgcgtcagcgctgacgtagattacgtcataggggagtggtcctgtattagctgtcacgtgagtgcttttgcgacattttgcgacaccacatggccatttgaggtatatatggccgagtgagcgagcaggatctccattttgaccgcgaaatttgaacgagcagcagccatgccgggcttctacgagattgtgatcaaggtgccgagcgacctggacgagcacctgccgggcatttctgactcttttgtgaactgggtggccgagaaggaatgggagctgcccccggattctgacatggatcggaatctgatcgagcaggcacccctgaccgtggccgagaagctgcagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggagaagctggtccagaccatctaccgcgggatcgagccgaccctgcccaactggttcgcggtgaccaagacgcgtaatggcgccggcggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtaggcccttcacttccggtggacattacgcagaaccgcatctaccgcatcctgcagctcaacggctacgaccctgcctacgccggctccgtctttctcggctgggcacaaaagaagttcgggaaacgcaacaccatctggctgtttgggccggccaccacgggaaagaccaacatcgcagaagccattgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccactcccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgcttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacggcaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtaattcctcgggaaattggcattgcgattccacatggctgggggacagagtcatcaccaccagcacccgaacctgggcattgcccacctacaacaaccacctctacaagcaaatctccaatggaacatcgggaggaagcaccaacgacaacacctactttggctacagcaccccctgggggtattttgacttcaacagattccactgccacttctcaccacgtgactggcagcgactcatcaacaacaactggggattccggccaaagagactcaacttcaagctgttcaacatccaggtcaaggaggttacgacgaacgaaggcaccaagaccatcgccaataaccttaccagcaccgtccaggtctttacggactcggagtaccagctaccgtacgtcctaggctctgcccaccaaggatgcctgccaccgtttcctgcagacgtcttcatggttcctcagtacggctacctgacgctcaacaatggaagtcaagcgttaggacgttcttctttctactgtctggaatacttcccttctcagatgctgagaaccggcaacaactttcagttcagctacactttcgaggacgtgcctttccacagcagctacgcacacagccagagtctagatcgactgatgaaccccctcatcgaccagtacctatactacctggtcagaacacagacaactggaactgggggaactcaaactttggcattcagccaagcaggccctagctcaatggccaatcaggctagaaactgggtacccgggccttgctaccgtcagcagcgcgtctccacaaccaccaaccaaaataacaacagcaactttgcgtggacgggagctgctaaattcaagctgaacgggagagactcgctaatgaatcctggcgtggctatggcatcgcacaaagacgacgaggaccgcttctttccatcaagtggcgttctcatatttggcaagcaaggagccgggaacgatggagtcgactacagccaggtgctgattacagatgaggaagaaattaaagccaccaaccctgtagccacagaggaatacggagcagtggccatcaacaaccaggccgctaacacgcaggcgcaaactggacttgtgcataaccagggagttattcctggtatggtctggcagaaccgggacgtgtacctgcagggccctatttgggctaaaatacctcacacagatggcaactttcacccgtctcctctgatgggtggatttggactgaaacacccacctccacagattctaattaaaaatacaccagtgccggcagatcctcctcttaccttcaatcaagccaagctgaactctttcatcacgcagtacagcacgggacaagtcagcgtggaaatcgagtgggagctgcagaaagaaaacagcaagcgctggaatccagagatccagtatacttcaaactactacaaatctacaaatgtggactttgctgtcaataccaaaggtgtttactctgagcctcgccccattggtactcgttacctcacccgtaatttgtaattgcctgttaatcaataaaccggttaattcgtttcagttgaactttggtctctgcg

SEQ ID NO: 5172 - DNA, 4382 bp, Adeno-associated virus 9
cagagagggagtggccaactccatcactaggggtaatcgcgaagcgcctcccacgctgccgcgtcagcgctgacgtagattacgtcataggggagtggtcctgtattagctgtcacgtgagtgcttttgcgacattttgcgacaccacatggccatttgaggtatatatggccgagtgagcgagcaggatctccattttgaccgcgaaatttgaacgagcagcagccatgccgggcttctacgagattgtgatcaaggtgccgagcgacctggacgagcacctgccgggcatttctgactcttttgtgaactgggtggccgagaaggaatgggagctgcccccggattctgacatggatcggaatctgatcgagcaggcacccctgaccgtggccgagaagctgtagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggagaagctggtccagaccatctaccgcgggatcgagccgaccctgcccaactggttcgcggtgaccaagacgcgtaatggcgccggcggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtaggcccttcacttccggtggacattacgcagaaccgcatctaccgcatcctgcagctcaacggctacgaccctgcctacgccggctccgtctttctcggctgggcacaaaagaagttcgggaaacgcaacaccatctggctgtttgggccggccaccacgggaaagaccaacatcgcagaagccattgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccactcccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgcttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcaccccaagaaccagactcatcctcgggcatcggcaaatcaggccagcagcccgctaaaaagagactcaattttggtcagactggcgactcagagtcagtccccgacccacaacctctcggagaacctccagaagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggcattgcccacctacaacaaccacctctacaagcaaatctccaatggaacatcgggaggaagcaccaacgacaacacctactttggctacagcaccccctgggggtattttgacttcaacagattccactgccacttctcaccacgtgactggcagcgactcatcaacaacaactggggattccggccaaagagactcaacttcaagctgttcaacatccaggtcaaggaggttacgacgaacgaaggcaccaagaccatcgccaataaccttaccagcaccgtccaggtctttacggactcggagtaccagctaccgtacgtcctaggctctgcccaccaaggatgcctgccaccgtttcctgcagacgtcttcatggttcctcagtacggctacctgacgctcaacaatggaagtcaagcgttaggacgttcttctttctactgtctggaatacttcccttctcagatgctgagaaccggcaacaactttcagttcagctacactttcgaggacgtgcctttccacagcagctacgcacacagccagagtctagatcgactgatgaaccccctcatcgaccagtacctatactacctggtcagaacacagacaactggaactgggggaactcaaactttggcattcagccaagcaggccctagctcaatggccaatcaggctagaaactgggtacccgggccttgctaccgtcagcagcgcgtctccacaaccaccaaccaaaataacaacagcaactttgcgtggacgggagctgctaaattcaagctgaacgggagagactcgctaatgaatcctggcgtggctatggcatcgcacaaagacgacgaggaccgcttctttccatcaagtggcgttctcatatttggcaagcaaggagccgggaacgatggagtcgactacagccaggtgctgattacagatgaggaagaaattaaagccaccaaccctgtagccacagaggaatacggagcagtggccatcaacaaccaggccgctaacacgcaggcgcaaactggacttgtgcataaccagggagttattcctggtatggtctggcagaaccgggacgtgtacctgcagggccctatttgggctaaaatacctcacacagatggcaactttcacccgtctcctctgatgggtggatttggactgaaacacccacctccacagattctaattaaaaatacaccagtgccggcagatcctcctcttaccttcaatcaagccaagctgaactctttcatcacgcagtacagcacgggacaagtcagcgtggaaatcgagtgggagctgcagaaagaaaacagcaagcgctggaatccagagatccagtatacttcaaactactacaaatctacaaatgtggactttgctgtcaataccgaaggtgtttactctgagcctcgccccattggtactcgttacctcacccgtaatttgtaattgcctgttaatcaataaaccggttaattcgtttcagttgaactttggtctctgcg

SEQ ID NO: 5173 - protein, 736 aa, Adeno-associated virus 9; identical to SEQ ID NO: 4805

SEQ ID NO: 5174 - protein, 736 aa, Adeno-associated virus 9
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKSGQQPAKKRLNFGQTGDSESVPDPQPLGEPPEAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 5175 - protein, 623 aa, Adeno-associated virus 9
MPGFYEIVIKVPSDLDEHLPGISDSFVNWVAEKEWELPPDSDMDRNLIEQAPLTVAEKLQRDFLVQWRRVSKAPEALFFVQFEKGESYFHLHVLVETTGVKSMVLGRFLSQIREKLVQTIYRGIEPTLPNWFAVTKTRNGAGGGNKVVDECYIPNYLLPKTQPELQWAWTNMEEYISACLNLAERKRLVAQHLTHVSQTQEQNKENLNPNSDAPVIRSKTSARYMELVGWLVDRGITSEKQWIQEDQASYISFNAASNSRSQIKAALDNAGKIMALTKSAPDYLVGPSLPVDITQNRIYRILQLNGYDPAYAGSVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLEHDFGKVTKQEVKEFFRWASDHVTEVAHEFYVRKGGASKRPAPDDADKSEPKRACPSVADPSTSDAEGAPVDFADRYQNKCSRHAGMLQMLLPCKTCERMNQNFNICFTHGVRDCSECFPGVSESQPVVRKRTYRKLCAIHHLLGRAPEIACSACDLVNVDLDDCVSEQ

SEQ ID NO: 5176 - DNA, 1797 bp, Artificial Sequence
  Description of Artificial Sequence: Synthetic polynucleotide
acggctccgaccggagacaagcggaaaggcgaagacgaacctcgtttgcccgacacttcttcacagactcccaagaaaaacaagaagcctcgcaaggaaagaccttccggcggggcagaagatccgggcgaaggcacctcttccaacgctggagcagcagcacccgcctctagtgtgggatcatctatcatggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaa

SEQ ID NO: 5177 - DNA, 1989 bp, Artificial Sequence
  Description of Artificial Sequence: Synthetic polynucleotide
atgaggtcgtactacgaggtcatcgttcagctgcccaacgacgtcgagagtcaggtacctggaatctccgattcgttcgtcaactggattacgtcgcgagaatggacgttgcctgaggacgccgattgggatttggaccaggtcgatcaagttcaactgacgctcggcgacaaaatccaacgggagattcgaactcattgggggacgatggccaaagaaccggactttcactattttatccaactggaacaaggtgaggtgttctttcatttacacgtcctgctggaaacgtgttccgtaaagccgatggtactcggaagatatatccgacatattcaacaaaaaattgtgagtaaagtctactgcgccacgagcctacgatggaaggatggatgcgtggtgaccaagaccaaaaatttcgggggcgcgaacaaggtccgggccgagtcgtatattcccgcctacctgatcccgaaacagcaaccggaagtgcagtgggcgtggactaacgtgcccgagtatataaaagcgtgcttgcaccgagaactgcgtgccagtctcgcgcgacttcacttcgaggaggcgggcgtctcgcaatccaaggaaaatctcgcgagaactgcagacggcgctcccgtgatgccgacccgcgtcagcaaacgctacatggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccaggtatcgtatcaaatgctcgaaacattgcggtatggataaaatgttgtttccttgccaaatttgtgaatcgatgaacagagatattaatatttgtgctattcataaaacgaccgactgtaaagagtgtttccccgactacggggataaagatgatgtagaactacccccctgtacagaacacaacgtgtctcgttgttatcaatgtcattcgggcgaattgtatcgcgtgacttcggactctgacgagaaacctgcccccgagagtgatgaaggcaccgagccatcctatgctccctgcacgattcaccacctgatgggcaagagtcacgggttagtcacttgcgcggcgtgtcggttgaaaaatagtacgttgcatgatgacttggatgacggtgatctcgaacaataa

SEQ ID NO: 5178 - DNA, 1626 bp, Artificial Sequence
  Description of Artificial Sequence: Synthetic polynucleotide
atgaggtcgtactacgaggtcatcgttcagctgcccaacgacgtcgagagtcaggtacctggaatctccgattcgttcgtcaactggattacgtcgcgagaatggacgttgcctgaggacgccgattgggatttggaccaggtcgatcaagttcaactgacgctcggcgacaaaatccaacgggagattcgaactcattgggggacgatggccaaagaaccggactttcactattttatccaactggaacaaggtgaggtgttctttcatttacacgtcctgctggaaacgtgttccgtaaagccgatggtactcggaagatatatccgacatattcaacaaaaaattgtgagtaaagtctactgcgccacgagcctacgatggaaggatggatgcgtggtgaccaagaccaaaaatttcgggggcgcgaacaaggtccgggccgagtcgtatattcccgcctacctgatcccgaaacagcaaccggaagtgcagtgggcgtggactaacgtgcccgagtatataaaagcgtgcttgcaccgagaactgcgtgccagtctcgcgcgacttcacttcgaggaggcgggcgtctcgcaatccaaggaaaatctcgcgagaactgcagacggcgctcccgtgatgccgacccgcgtcagcaaacgctacatggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccagattggttggagcggttggtcaaaaagggagtgaatgctgcagctga

SEQ ID NO: 5179 - DNA, 1323 bp, Artificial Sequence
  Description of Artificial Sequence: Synthetic polynucleotide
atggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccaggtatcgtatcaaatgctcgaaacattgcggtatggataaaatgttgtttccttgccaaatttgtgaatcgatgaacagagatattaatatttgtgctattcataaaacgaccgactgtaaagagtgtttccccgactacggggataaagatgatgtagaactacccccctgtacagaacacaacgtgtctcgttgttatcaatgtcattcgggcgaattgtatcgcgtgacttcggactctgacgagaaacctgcccccgagagtgatgaaggcaccgagccatcctatgctccctgcacgattcaccacctgatgggcaagagtcacgggttagtcacttgcgcggcgtgtcggttgaaaaatagtacgttgcatgatgacttggatgacggtgatctcgaacaataa

SEQ ID NO: 5180 - DNA, 960 bp, Artificial Sequence
  Description of Artificial Sequence: Synthetic polynucleotide
atggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccagattggttggagcggttggtcaaaaagggagtgaatgctgcagctga

SEQ ID NO: 5181 - DNA, 1608 bp, Artificial Sequence
  Description of Artificial Sequence: Synthetic polynucleotide
atggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaa

SEQ ID NO: 5182 - DNA, 2232 bp, Artificial Sequence
  Description of Artificial Sequence: Synthetic polynucleotide
atgtctctcatttctgatgcgattccagattggttggagcggttggtcaaaaagggagtgaatgctgcagctgatttctaccatttggaaagcggtcctcctcgtcctaaggcaaatcagcaaactcaagaatctcttgaaaaggacgattcgagaggtctcgtgttcccaggctacaattatctaggccctttcaacggtctagataaaggagaacccgtcaacgaggcagacgctgccgccttagaacacgacaaggcttacgacctcgaaatcaaggacgggcacaacccgtactttgagtacaacgaggccgacagacgtttccaggaacgtctcaaagacgatacctcctttggaggcaatttaggtaaagccatcttccaggccaaaaagagggttctcgaaccctttggtctggtggaagactcaaagacggctccgaccggagacaagcggaaaggcgaagacgaacctcgtttgcccgacacttcttcacagactcccaagaaaaacaagaagcctcgcaaggaaagaccttccggcggggcagaagatccgggcgaaggcacctcttccaacgctggagcagcagcacccgcctctagtgtgggatcatctatcatggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaa

SEQ ID NO: 5183 - protein, 535 aa, Artificial Sequence
  Description of Artificial Sequence: Synthetic polypeptide
MAEGGGGPVGDAGQGADGVGNSSGNWHCDSQWLENGVVTRTTRTWVLPSYNNHLYKRIQGPSGGDNNNKFFGFSTPWGYFDYNRFHCHFSPRDWQRLINNNWGIRPKAMRFRLFNIQVKEVTVQDFNTTIGNNLTSTVQVFADKDYQLPYVLGSATEGTFPPFPADIYTIPQYGYCTLNYNNEAVDRSAFYCLDYFPSDMLRTGNNFEFTYTFEDVPFHSMFAHNQTLDRLMNPLVDQYLWAFSSVSQAGSSGRALHYSRATKTNMAAQYRNWLPGPFFRDQQIFTGASNITKNNVFSVWEKGKQWELDNRTNLMQPGPAAATTFSGEPDRQAMQNTLAFSRTVYDQTTATTDRNQILITNEDEIRPTNSVGIDAWGAVPTNNQSIVTPGTRAAVNNQGALPGMVWQNRDIYPTGTHLAKIPDTDNHFHPSPLIGRFGCKHPPPQIFIKNTPVPANPSETFQTAKVASFINQYSTGQCTVEIFWELKKETSKRWNPEIQFTSNFGNAADIQFAVSDTGSYSEPRPIGTRYLTKPL

SEQ ID NO: 5184 - protein, 440 aa, Artificial Sequence
  Description of Artificial Sequence: Synthetic polypeptide
MELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRYRIKCSKHCGMDKMLFPCQICESMNRDINICAIHKTTDCKECFPDYGDKDDVELPPCTEHNVSRCYQCHSGELYRVTSDSDEKPAPESDEGTEPSYAPCTIHHLMGKSHGLVTCAACRLKNSTLHDDLDDGDLEQ

SEQ ID NO: 5185 - protein, 319 aa, Artificial Sequence
  Description of Artificial Sequence: Synthetic polypeptide
MELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRLVGAVGQKGSECCS

SEQ ID NO: 5186 - protein, 662 aa, Artificial Sequence
  Description of Artificial Sequence: Synthetic polypeptide
MRSYYEVIVQLPNDVESQVPGISDSFVNWITSREWTLPEDADWDLDQVDQVQLTLGDKIQREIRTHWGTMAKEPDFHYFIQLEQGEVFFHLHVLLETCSVKPMVLGRYIRHIQQKIVSKVYCATSLRWKDGCVVTKTKNFGGANKVRAESYIPAYLIPKQQPEVQWAWTNVPEYIKACLHRELRASLARLHFEEAGVSQSKENLARTADGAPVMPTRVSKRYMELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRYRIKCSKHCGMDKMLFPCQICESMNRDINICAIHKTTDCKECFPDYGDKDDVELPPCTEHNVSRCYQCHSGELYRVTSDSDEKPAPESDEGTEPSYAPCTIHHLMGKSHGLVTCAACRLKNSTLHDDLDDGDLEQ

SEQ ID NO: 5187 - protein, 541 aa, Artificial Sequence
  Description of Artificial Sequence: Synthetic polypeptide
MRSYYEVIVQLPNDVESQVPGISDSFVNWITSREWTLPEDADWDLDQVDQVQLTLGDKIQREIRTHWGTMAKEPDFHYFIQLEQGEVFFHLHVLLETCSVKPMVLGRYIRHIQQKIVSKVYCATSLRWKDGCVVTKTKNFGGANKVRAESYIPAYLIPKQQPEVQWAWTNVPEYIKACLHRELRASLARLHFEEAGVSQSKENLARTADGAPVMPTRVSKRYMELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRLVGAVGQKGSECCS

SEQ ID NO: 5188 - protein, 743 aa, Artificial Sequence
  Description of Artificial Sequence: Synthetic polypeptide
MSLISDAIPDWLERLVKKGVNAAADFYHLESGPPRPKANQQTQESLEKDDSRGLVFPGYNYLGPFNGLDKGEPVNEADAAALEHDKAYDLEIKDGHNPYFEYNEADRRFQERLKDDTSFGGNLGKAIFQAKKRVLEPFGLVEDSKTAPTGDKRKGEDEPRLPDTSSQTPKKNKKPRKERPSGGAEDPGEGTSSNAGAAAPASSVGSSIMAEGGGGPVGDAGQGADGVGNSSGNWHCDSQWLENGVVTRTTRTWVLPSYNNHLYKRIQGPSGGDNNNKFFGFSTPWGYFDYNRFHCHFSPRDWQRLINNNWGIRPKAMRFRLFNIQVKEVTVQDFNTTIGNNLTSTVQVFADKDYQLPYVLGSATEGTFPPFPADIYTIPQYGYCTLNYNNEAVDRSAFYCLDYFPSDMLRTGNNFEFTYTFEDVPFHSMFAHNQTLDRLMNPLVDQYLWAFSSVSQAGSSGRALHYSRATKTNMAAQYRNWLPGPFFRDQQIFTGASNITKNNVFSVWEKGKQWELDNRTNLMQPGPAAATTFSGEPDRQAMQNTLAFSRTVYDQTTATTDRNQILITNEDEIRPTNSVGIDAWGAVPTNNQSIVTPGTRAAVNNQGALPGMVWQNRDIYPTGTHLAKIPDTDNHFHPSPLIGRFGCKHPPPQIFIKNTPVPANPSETFQTAKVASFINQYSTGQCTVEIFWELKKETSKRWNPEIQFTSNFGNAADIQFAVSDTGSYSEPRPIGTRYLTKPL

SEQ ID NO: 5189 - protein, 598 aa, Artificial Sequence
  Description of Artificial Sequence: Synthetic polypeptide
TAPTGDKRKGEDEPRLPDTSSQTPKKNKKPRKERPSGGAEDPGEGTSSNAGAAAPASSVGSSIMAEGGGGPVGDAGQGADGVGNSSGNWHCDSQWLENGVVTRTTRTWVLPSYNNHLYKRIQGPSGGDNNNKFFGFSTPWGYFDYNRFHCHFSPRDWQRLINNNWGIRPKAMRFRLFNIQVKEVTVQDFNTTIGNNLTSTVQVFADKDYQLPYVLGSATEGTFPPFPADIYTIPQYGYCTLNYNNEAVDRSAFYCLDYFPSDMLRTGNNFEFTYTFEDVPFHSMFAHNQTLDRLMNPLVDQYLWAFSSVSQAGSSGRALHYSRATKTNMAAQYRNWLPGPFFRDQQIFTGASNITKNNVFSVWEKGKQWELDNRTNLMQPGPAAATTFSGEPDRQAMQNTLAFSRTVYDQTTATTDRNQILITNEDEIRPTNSVGIDAWGAVPTNNQSIVTPGTRAAVNNQGALPGMVWQNRDIYPTGTHLAKIPDTDNHFHPSPLIGRFGCKHPPPQIFIKNTPVPANPSETFQTAKVASFINQYSTGQCTVEIFWELKKETSKRWNPEIQFTSNFGNAADIQFAVSDTGSYSEPRPIGTRYLTKPL

SEQ ID NO: 5190 - DNA, 4694 bp, Artificial Sequence
  Description of Artificial Sequence: Synthetic polynucleotide
tggccagtttccaagacaggctcgctcgctcactcgggccggggccccaaaggggcccctagcgaccgcttcgcggtcgcggcccgagtgagcgagcgagcctgtcttggaaactggccagcactccggtgaggtaatgccgtcacgtggtcgggaatgggaacgggaaatctcgcgagaacgtaaacaaatataagacggcgccacacggcgctgcgtcatacgcgcgcgcgcaccggcgagatgaggtcgtactacgaggtcatcgttcagctgcccaacgacgtcgagagtcaggtacctggaatctccgattcgttcgtcaactggattacgtcgcgagaatggacgttgcctgaggacgccgattgggatttggaccaggtcgatcaagttcaactgacgctcggcgacaaaatccaacgggagattcgaactcattgggggacgatggccaaagaaccggactttcactattttatccaactggaacaaggtgaggtgttctttcatttacacgtcctgctggaaacgtgttccgtaaagccgatggtactcggaagatatatccgacatattcaacaaaaaattgtgagtaaagtctactgcgccacgagcctacgatggaaggatggatgcgtggtgaccaagaccaaaaatttcgggggcgcgaacaaggtccgggccgagtcgtatattcccgcctacctgatcccgaaacagcaaccggaagtgcagtgggcgtggactaacgtgcccgagtatataaaagcgtgcttgcaccgagaactgcgtgccagtctcgcgcgacttcacttcgaggaggcgggcgtctcgcaatccaaggaaaatctcgcgagaactgcagacggcgctcccgtgatgccgacccgcgtcagcaaacgctacatggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccaggtatcgtatcaaatgctcgaaacattgcggtatggataaaatgttgtttccttgccaaatttgtgaatcgatgaacagagatattaatatttgtgctattcataaaacgaccgactgtaaagagtgtttccccgactacggggataaagatgatgtagaactacccccctgtacagaacacaacgtgtctcgttgttatcaatgtcattcgggcgaattgtatcgcgtgacttcggactctgacgagaaacctgcccccgagagtgatgaaggcaccgagccatcctatgctccctgcacgattcaccacctgatgggcaagagtcacgggttagtcacttgcgcggcgtgtcggttgaaaaatagtacgttgcatgatgacttggatgacggtgatctcgaacaataaatgattgaaatgtagccatgtctctcatttctgatgcgattccagattggttggagcggttggtcaaaaagggagtgaatgctgcagctgatttctaccatttggaaagcggtcctcctcgtcctaaggcaaatcagcaaactcaagaatctcttgaaaaggacgattcgagaggtctcgtgttcccaggctacaattatctaggccctttcaacggtctagataaaggagaacccgtcaacgaggcagacgctgccgccttagaacacgacaaggcttacgacctcgaaatcaaggacgggcacaacccgtactttgagtacaacgaggccgacagacgtttccaggaacgtctcaaagacgatacctcctttggaggcaatttaggtaaagccatcttccaggccaaaaagagggttctcgaaccctttggtctggtggaagactcaaagacggctccgaccggagacaagcggaaaggcgaagacgaacctcgtttgcccgacacttcttcacagactcccaagaaaaacaagaagcctcgcaaggaaagaccttccggcggggcagaagatccgggcgaaggcacctcttccaacgctggagcagcagcacccgcctctagtgtgggatcatctatcatggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaaattaaacccttcaataaaccgtttatgcgtaactgtatttccgtctcctgtcgttattcagtcacatgatgcggcattacctcaccggagtgctggccagtttccaagacaggctcgctcgctcactcgggccggggccccaaaggggcccctagcgaccgcttcgcggtcgcggcccgagtgagcgagcgagcctgtcttggaaactggcca

SEQ ID NO: 5191 - DNA, 2211 bp, Artificial Sequence
  Description of Artificial Sequence: Synthetic polynucleotide
atggctgctgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgcagcggccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagagactcaattttggtcagactggcgactcagagtcagtccccgacccacaacctctcggagaacctccagcaacccccgctgctgtgggacctactacaatggcttcaggtggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcagactatcagctcccgtacgtgctcgggtcggctcacgagggctgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 5192 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSDYQLPYVLGSAHEGCLPPFPADVFMVPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5193 - DNA, 2211 bp, Artificial Sequence
  Description of Artificial Sequence: Synthetic polynucleotide
atggcttccgatggttatcttccagattggctcgaggacaacctctctgagggcatccgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcagagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcccatttgggccaaaattcctcacacagatggacactttcacccgtctcctcttatgggcggctttggacttaagcacccgcctcctcagatcctcatcaaaaacacgcctgttcctgcgaatcctccggcagagttttcggctacaaagtttgcttcattcatcacccagtattctactggccaagtcagcgtggagattgaatgggagctgcagaaagaaaacagcaaacgctggaatcccgaagtgcagtatacatctaactatgcaaaatctgccaacgttgatttcactgtggacaacaatggactttatactgagcctcgtcccattggcacccgttacctcacccgtcccctgtaa

SEQ ID NO: 5194 - protein, 736 aa, Artificial Sequence
  Description of Artificial Sequence: Synthetic polypeptide
MASDGYLPDWLEDNLSEGIREWWDLKPGAPKPKANQQKQDDGRGLVLPGYKYLGPFNGLDKGEPVNAADAAALEHDKAYDQQLRAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5195 - DNA, 2211 bp, Artificial Sequence
  Description of Artificial Sequence: Synthetic polynucleotide
atggctgctgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgcagcggccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagagactcaattttggtcagactggcgactcagagtcagtccccgacccacaacctctcggagaacctccagcaacccccgctgctgtgggacctactacaatggcttcaggtggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcagactatcagctcccgtacgtgctcgggtcggctcacgagggctgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacctgaacagaactcagaatcagtccggaagtgcccaaaacaaggacttgctgtttagccgggggtctccaactggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccactgaaagatttgggactgtggcagtcaatctccagagcagcagcacagaccctgcgaccggagatgtgcatgccatgggagccttacctggaatggtgtggcaagacagagacgtatacctgcagggtcctatttgggccaaaattcctcacacggatggacactttcacccgtctcctctcatgggcggctttggactcaagaacccgcctcctcagatcctcatcaaaaacacgcctgttcctgcgaatcctccggcggagttttcagctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 5196 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSDYQLPYVLGSAHEGCLPPFPADVFMVPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPTGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5197 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcaatcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcgacgggggccagcaacgacaaccactacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgatcaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacataaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagcgtggagattgaatgggagctgcagaaagaaaacagcaaacgctggaatcccgaagtgcagtatacatctaactatgcaaaatctgccaacattgatttcactgtggacaacaatggactttatactgagcctcgccccattggcacccgttacctcacccgtccccagtaa

SEQ ID NO: 5198 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLSFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANIDFTVDNNGLYTEPRPIGTRYLTRPQ

SEQ ID NO: 5199 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtaccttcggtataaccacgccgacgccgagtttcaggagcgtctgcaagaagatacgtcttttgggggcaacctcgggcgagcagtcttccaggccaaaaagagggttctcgaacctctcggtctggttgaggaagcggctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctcccgcagccccctcaggtgtgggatctcttacaatggcttcaggtggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcaaagactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggaagtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttaccggcagcagtgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagcgtggagattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttacctcacccgtcccctgtaa

SEQ ID NO: 5200 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEQSPQEPDSSSGIGKTGQQPAKKRLNFGQTGDSESVPDPQPLGEPPAAPSGVGSLTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQCVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5201 - DNA, 2211 bp, Artificial Sequence
  Description of Artificial Sequence: Synthetic polynucleotide
atggctgccgatggttatcttccagattggctcgaggacaacctctctgagggcattcgcgaatggtgggacttgaaacctggagccccgaaacccaaagtcaaccagcaaaagcaggacaacgctcggggtcttgtgcttccgggttacaaatacctcggacccttcaacggactcgacaagggggagcccgtcaacgcggcggacgcagcggccctcgagcacgacaaggcctacgaccagcagctcaaagcgggtgacaatccgtaccttcggtataaccacgccgacgccgagtttcaggagcgtctgcaagaagatacgtcttttgggggcaaccttggacgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcaaagactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcaatacggctacctgacgctcaacaatggcagccaggcagtgggacggtcatccttttactgcctggaatatttcccatcgcagatgctgagaacgggcaataactttaccttcagctacacttttgaggacgttcctttccacagcagctacgctcacagccagagcctggaccggctgatgaatcctctcatcgaccagtacctgtattacctgaacagaactcagaatcagtccggaagtgcccaaaacaaggacttgctgtttagccgtgggtctccaactggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagaggaaatcaaagccactaaccccgtggccactgaaagatttgggactgtggcagtcaatctccagagcagcagcacagaccctgcgaccggagatgtgcatgccatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 5202 - protein, 736 aa, Artificial Sequence
  Description of Artificial Sequence: Synthetic polypeptide
MAADGYLPDWLEDNLSEGIREWWDLKPGAPKPKVNQQKQDNARGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPTGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5203 - DNA, 2208 bp, Artificial Sequence
  Description of Artificial Sequence: Synthetic polynucleotide
  modified_base (955)..(955): a, c, t or g
  modified_base (971)..(972): a, c, t or g
  modified_base (981)..(981): a, c, t or g
  modified_base (986)..(986): a, c, t or g
  modified_base (1235)..(1235): a, c, t or g
  modified_base (1694)..(1696): a, c, t or g
  modified_base (1698)..(1698): a, c, t or g
  modified_base (1763)..(1765): a, c, t or g
  modified_base (1778)..(1778): a, c, t or g
  modified_base (2204)..(2204): a, c, t or g
atggctgccgatggttatcttccagattggctcgaggacaacctctctgagggcattcgcgaatggtgggacttgaaacctggagccccgaaacccaaagtcaaccagcaaaagcaggacaacgctcggggtcttgtgcttccgggttacaaatacctcggacccttcaacggactcgacaagggggagcccgtcaacgcggcggacgcagcggccctcgagcacgacaaggcctacgaccagcagctcaaagcgggtgacaatccgtaccttcggtataaccacgccgacgccgagtttcaggagcgtctgcaagaagatacgtcttttgggggcaaccttggacgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccacttttcaccacgtgactggcagcgactcatcaataacaattggggattccggcccaagagactcaacttcaaactcttcaacntccaagtcaaggaggnnacgacgaangatgncgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaggcagtgggacggtcatccttttactgcctggaatatttcccatcgcagatgctgagaacgggcaataactttacctncagctacacttttgaggacgttcctttccacagcagctacgctcacagccagagcctggaccggctgatgaatcctctcatcgaccagtacctgtattacctgaacagaactcagaatcagtccggaagtgcccaaaacaaggacttgctgtttagccgtgggtctccaactggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagagannncnaagccactaaccccgtggccactgaaagatttgggactgtggcagtcaatctccaagcagcacannnaccctgcgaccgnagatgtgcatgccatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtccccngtaa

SEQ ID NO: 5204 - protein, 723 aa, Artificial Sequence
  Description of Artificial Sequence: Synthetic polypeptide
MAADGYLPDWLEDNLSEGIREWWDLKPGAPKPKVNQQKQDNARGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNQVKETTDVTTIANNLTSTVQVFSDSEYQLPYVLGSAHQGCLPPFPADVFMIPQYGYLTLNNGSQAVGRSSFYCLEYFPSQMLRTGNNFTSYTFEDVPFHSSYAHSQSLDRLMNPLIDQYLYYLNRTQNQSGSAQNKDLLFSRGSPTGMSVQPKNWLPGPCYRQQRVSKTKTDNNNSNFTWTGASKYNLNGRESIINPGTAMASHKDDEDKFFPMSGVMIFGKESAGASNTALDNVMITDEEATNPVATERFGTVAVNLQSSPATDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 5205 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggtcagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacgctccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtattcagagcctcgccccattggcaccagatacctgactcgtaatctgtaa

SEQ ID NO: 5206 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTDAPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYSEPRPIGTRYLTRNL

SEQ ID NO: 5207 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcaaactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcgggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacgaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtatacagagcctcgccccattggcaccagatacctgactcgtaatctgtaa

SEQ ID NO: 5208 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDANSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSRAVGRSSFYCLEYFPSQMLRTGNNFTFSYTFEDVPFHSSYAHSQSLDRLMNPLIDQYLYYLSRTDTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYTEPRPIGTRYLTRNL

SEQ ID NO: 5209 - DNA, 2211 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcgacgggggccagcaacgacaaccactacttcggctacagcaccccctgggggtattttgactttaacagattccactgccacttttcaccacgtgactggcagcgactcatcaacaataactggggattccggcccaagagactcagcttcaagctcttcaacatccaggtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgatcaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacggacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcactcaatactccacaggacaagtgagcgtggaaattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 5210 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLSFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5211 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTDTPSGTTTQSRLQFSQAGASDIRNQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYSEPRPIGTRYLTRNQ

SEQ ID NO: 5212 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggaacgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacactccaagtggaaccaccacgcagtcaaggcttcagttttctcaggccggagcgagtgacattcggaaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtattcagagcctcgccccattggcaccagatacctgactcgtaatcagtaa

SEQ ID NO: 5213 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgatccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtatgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtattcagagcctcgccccattggcaccagatacctgactcgtaatctgtaa

SEQ ID NO: 5214 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTDTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYSEPRPIGTRYLTRNL

SEQ ID NO: 5215 - DNA, 2172 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctt

SEQ ID NO: 5216 - DNA, 2214 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcctgagcggacggcgatgagtcttccgggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctg

SEQ ID NO: 5217 - protein, 738 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLPERTAMSLPGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 5218 - DNA, 2214 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgagttttagtcgtgcggttctttgtgatggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctg

SEQ ID NO: 5219 - protein, 738 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLSFSRAVLCDGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 5220 - DNA, 2215 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcactctcctgtggagccagactcctcctcgggaaccggaaaggcgggccagcagcctgcaagaaaaagattgaattttggtcagactggagacgcagactcagtcccagaccctcaaccaatcggagaacctcccgcagccccctcaggtgtgggatctcttacaatggctgcaggcggtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaagcaaatctccaacagcacatctggaggatcttcaaatgacaacgcctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacgacaaatacgcagactctgggcttcagccaaggtgggcctaatacaatggccaatcaggcaaagaactggctgccaggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagtttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctccgcctcagatcctgatcaagaacacgcctgtacctgcggatcctccgaccaccttcaaccagtcaaagctgaactctttcatcacccagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 5221 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEHSPVEPDSSSGTGKAGQQPARKRLNFGQTGDADSVPDPQPIGEPPAAPSGVGSLTMAAGGGAPMADNNEGADGVGNSSGNWHCDSTWMGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLKTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 5222 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEHSPVEPDSSSGTGKAGQQPARKRLNFGQTGDADSVPDPQPIGEPPAAPSGVGSLTMAAGGGAPMADNNEGADGVGNSSGNWHCDSTWMGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLKTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQQGNTQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 5223 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEHSPVEPDSSSGTGKAGQQPARKRLNFGQTGDADSVPDPQPIGEPPAAPSGVGSLTMAAGGGAPMADNNEGADGVGNSSGNWHCDSTWMGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQQGNTQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 5224 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 5225 - protein, 737 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLQAGDNPYLRYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGSSSGNWHCDSQWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 5226 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 5227 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5228 - DNA, 2211 bp, Artificial Sequence
  Description of Artificial Sequence: Synthetic polynucleotide
atggctgctgacggttatcttccagattggctcgaggacaacctttctgaaggcattcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccccattggcacccgttaccttacccgtcccctgtaa

SEQ ID NO: 5229 - protein, 736 aa, Artificial Sequence
  Description of Artificial Sequence: Synthetic polypeptide
MAADGYLPDWLEDNLSEGIREWWALQPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRPL

SEQ ID NO: 5230 - DNA, 2211 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgcgtttctaaaacaaaaacagacaacaacaacagcaattttacctggactggtgcttcaaaatataaccttaatgggcgtgaatctataatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 5231 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5232 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagcccctaaacccaaggcaaatcaacaacatcaggacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcccctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtgtacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 5233 - protein, 736 aa, Artificial Sequence
  Description of Artificial Sequence: Synthetic polypeptide
MAADGYLPDWLEDNLSEGIREWWDLKPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5234 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatgactgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 5235 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLQAGDNPYLRYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGSSSGNWHCDSQLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 5236 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgccttttcacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 5237 - protein, 737 aa, Artificial Sequence; identical to SEQ ID NO: 5225
  Description of Artificial Sequence: Synthetic polypeptide

SEQ ID NO: 5238 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagcccctaaacccaaggcaaatcaacaacatcaggacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgcgtttctaaaacaaaaacagacaacaacaacagcaattttacctggactggtgcttcaaaatataaccttaatgggcgtgaatctataatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 5239 - protein, 736 aa, Artificial Sequence
  Description of Artificial Sequence: Synthetic polypeptide
MAADGYLPDWLEDNLSEGIREWWDLKPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5240 - DNA, 2211 bp, Artificial Sequence
  Description of Artificial Sequence: Synthetic polynucleotide
atggctgccgatggttatcttccagattggctcgaggacaaccttagtgaaggaattcgcgagtggtgggcgctgaaacctggagccccgaagcccaaagccaaccagcaaaagcaggacgacggccggggtctggtgcttccgggttacaaatacctcggacccggtaacggactcgacaaaggagagccggtcaacgaggcggacgcggcagccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcccggaaagaaacgtccggtagagcagtcgccacaagagccagactcctctacgggcatcggcaagaaaggccaacagcccgccagaaaaagactcaatttcggtcagactggcgactcagagtcagttccagaccctcaacctctcggagaacctccagcagcgccctctggtgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaacacctacttcggctacagcaccccctgggggtattttgatttcaacagattccactgccatttctcaccacgtgactggcagcgactcatcaacaacaattggggattccggcccaagagactcaacttcaaactcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagccttacctggaatggtgtggcaagacagagacgtatacctgcagggtcctatttgggccaaaattcctcacacagatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 5241 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPGNGLDKGEPVNEADAAALEHDKAYDQQLKAGDNPYLRYNHADAEFQERLQEDTSFGGNLGRAVFQAKKRVLEPLGLVEEGAKTAPGKKRPVEQSPQEPDSSTGIGKKGQQPARKRLNFGQTGDSESVPDPQPLGEPPAAPSGVGPTTMASGGGAPMADNNEGADGVGNASGNWHCDSTWLGDRVITTSTRTWALPTYNNHLYKQISSASTGASNDNTYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5242 - DNA, 2205 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcagcgactcatcaacaacaactggggattccggcccaagagactcagcttcaagctcttcaacatccaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 5243 - protein, 734 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSQSGASNDNHYFGYSTPWGYFDFNRFHCHFSPRDWQRLINNNWGFRPKRLSFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGLKHPPPQILIKNTPVPADPPTTFNQSKLNSFITQYSTGQVSVEIEWELQKENSKRWNPEVQYTSNYAKSANVDFTVDNNGLYTEPRPIGTRYLTRPL

SEQ ID NO: 5244 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagtgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaggagagcgccggagcttcaaacactgcattggacaatgtcatgatcaccgacgaagaggaaatcaaagccactaaccccgtggccaccgaaagatttgggactgtggcagtcaatctccagagcagcagcacagaccctgcgaccggagatgtgcatgttatgggagccttacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 5245 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKWVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5246 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctcggcgcaccagggctgcctccctccgttcccggcggacgtcttcatggtgccacagtatggatacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggacttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 5247 - protein, 737 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLQAGDNPYLRYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGSSSGNWHCDSQWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMVPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGDLPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 5248 - DNA, 2205 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaactgtcggggtcttgtgcttccgggttacaaatacctcggacccggtaacggactcgacaaaggagagccggtcaacgaggcggacgcggcagccctcgaacacgacaaggcctacgaccagcagctcaaggccggagacaacccgtacctcaagtacaaccacgccgacgccgagttccaggagcggctcaaagaagatacgtcttttgggggcaacctcgggcgagcagtcttccagaccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcagcgactcatcaacaacaactggggattccggcccaagagactcagcttcaagctcttcaacatccaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatctgggccaagattcctcacacggacggcaacttccacccgtctccgctgatgggcggctttggcctgaaacatcctccgcctcagatcctgatcaagaacacgcctgttcctgcgaatcctccggcggagttttcagctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttaccaaacctctgtaa

SEQ ID NO: 5249 - protein, 734 aa, Artificial Sequence
  Description of Artificial Sequence: Synthetic polypeptide
MAADGYLPDWLEDNLSEGIREWWALKPGVPQPKANQQHQDNCRGLVLPGYKYLGPGNGLDKGEPVNEADAAALEHDKAYDQQLKAGDNPYLKYNHADAEFQERLKEDTSFGGNLGRAVFQTKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSQSGASNDNHYFGYSTPWGYFDFNRFHCHFSPRDWQRLINNNWGFRPKRLSFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTKPL

SEQ ID NO: 5250 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagcccctaaacccaaggcaaatcaacaacatcaggacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgcgtttctaaaacaaaaacagacaacaacaacagcaattttacctggactggtgcttcaaaatataaccttaatgggcgtgaatctataatcaaccctggcactgctatggcctcacacaaagacgacgaagacaagttctttcccatgagcggtgtcatgatttttggaaaagagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 5251 - protein, 736 aa, Artificial Sequence
  Description of Artificial Sequence: Synthetic polypeptide
MAADGYLPDWLEDNLSEGIREWWDLKPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5252 - DNA, 2214 bp, Artificial Sequence; identical to SEQ ID NO: 5224
  Description of Artificial Sequence: Synthetic polynucleotide

SEQ ID NO: 5253 - protein, 737 aa, Artificial Sequence; identical to SEQ ID NO: 5225
  Description of Artificial Sequence: Synthetic polypeptide

SEQ ID NO: 5254 - DNA, 2205 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcagcgactcatcaacaacaactggggattccggcccaagagactcagcttcaagctcttcaacatccaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaaacacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 5255 - protein, 734 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSQSGASNDNHYFGYSTPWGYFDFNRFHCHFSPRDWQRLINNNWGFRPKRLSFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSTSVDFAVNTEGVYSEPRPIGTRYLTRNL

SEQ ID NO: 5256 - DNA, 2217 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccctctcccctcatgggtggattcggacttaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 5257 - protein, 738 aa, Artificial Sequence; identical to SEQ ID NO: 5159
  Description of Artificial Sequence: Synthetic polypeptide

SEQ ID NO: 5258 - DNA, 2211 bp, Artificial Sequence
  Description of Artificial Sequence: Synthetic polynucleotide
atggctgctgacggttatcttccagattggctcgaggacaacctttctgaaggcattcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaggtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccccattggcacccgttaccttacccgtcccctgtaa

SEQ ID NO: 5259 - protein, 736 aa, Artificial Sequence; identical to SEQ ID NO: 5229
  Description of Artificial Sequence: Synthetic polypeptide

SEQ ID NO: 5260 - DNA, 2211 bp, Artificial Sequence; identical to SEQ ID NO: 5228
  Description of Artificial Sequence: Synthetic polynucleotide

SEQ ID NO: 5261 - protein, 736 aa, Artificial Sequence; identical to SEQ ID NO: 5229
  Description of Artificial Sequence: Synthetic polypeptide

SEQ ID NO: 5262 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 5263 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5264 - DNA, 2217 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcaacggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgactttaaccgcttccactgccacttctcgccaagagactggcaaagactcatcaacaacaattggggattccggcccaagagactcaacttcaaactcttcaacatccaagtcaaggaggtcacgacgaatgatggcgtcacgaccatcgccaataacctcaccagcaccatccaggtgtttacggactcggagtaccagctgccgtacgttctcggctctgcccaccagggctgcctgcctccgttcccggcggacgtgttcatgattccccagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcagccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaggggcccatctgggcaaagattccacacacggacggacattttcacccctctcccctcatgggtggattcggacttaaacaccctcctccgcagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 5265 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADATALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTIQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYYKSNNVEFAVNTEGVYSEPRPIGTRYLTRNL

SEQ ID NO: 5266 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacctgggccctgcccacctacaacaaccacctctacaaacaaatttccagccaatcaggagcctcgaacgacaatcactactttggctacagcaccccttgggggtattttgatttcaacagattccactgccacttttcaccacgtgactggcagcgactcatcaacaacaattggggattccggcccaagagactcagcttcaagctcttcaacatccaggtcaaggaggtcacgcagaatgaaggcaccaagaccatcgccaataaccttaccagcacggttcaagtgtttacggactcggagtatcagctcccgtacgtgctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctgattgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggactatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccgtctccgctgatgggcggctttggcctgaaacatcctccgcctcagatcctgatcaagaacacgcctgtacctgcggatcctccgaccaccttcaaccagtcaaagctgaactctttcatcactcagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 5267 - protein, 735 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSQSGASNDNHYFGYSTPWGYFDFNRFHCHFSPRDWQRLINNNWGFRPKRLSFKLFNIQVKEVTQNEGTKTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDYEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 5268 - DNA, 2214 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgatttcaacagattccactgccatttctcaccacgtgactggcagcgactcatcaacaacaattggggattccggcccaagagactcaacttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacgacaaatacgcagactctgggcttcagccaaggtgggcctaatacaatggccaatcaggcaaagaactggctgccaggaccctgttaccgccagcagcgagtatcaaagacatttgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctccgcctcagatcctgatcaagaacacgcctgtacccgcggatcctccgaccaccttcaaccagtcaaagctgaactctttcatcacccagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 5269 - protein, 737 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPARKRLNFGQTGDADSVPDPQPLGQPPAAPSGLGTNTMATGSGAPMADNNEGADGVGNSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTTNTQTLGFSQGGPNTMANQAKNWLPGPCYRQQRVSKTFADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 5270 - DNA, 2217 bp, Artificial Sequence
  Description of Artificial Sequence: Synthetic polynucleotide
atggctgccgatggttatcttccagattggctcgaggacactctctctgaaggaataagacagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgactttaaccgcttccactgccacttctcgccaagagactggcaaagactcatcaacaacaattggggattccggcccaagagactcaacttcaaactcttcaacatccaagtcaaggaggtcacgacgaatgatggcgtcacgaccatcgccaataacctcaccagcaccatccaggtgtttacggactcggagtaccagctgccgtacgttctcggctctgcccaccagggctgcctgcctccgttcccggcggacgtgttcatgattccccagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcagccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaggggcccatctgggcaaagattccacacacggacggacattttcacccctctcccctcatgggtggattcggacttaaacaccctcctccgcagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 5271 - protein, 738 aa, Artificial Sequence
  Description of Artificial Sequence: Synthetic polypeptide
MAADGYLPDWLEDTLSEGIRQWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTIQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYYKSNNVEFAVNTEGVYSEPRPIGTRYLTRNL

SEQ ID NO: 5272 - DNA, 2208 bp, Artificial Sequence; identical to SEQ ID NO: 5102
  Description of Artificial Sequence: Synthetic polynucleotide

SEQ ID NO: 5273 - protein, 735 aa, Artificial Sequence [sequence omitted]

SEQ ID NO: 5274 - DNA, 2208 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgccgcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaaaaagaggcttcttgaacctcttggtctggttgaggaagcagctaaaacggctcctggaaagaagaggcctgtagagcagtctcctcaggaaccggactcctccgcgggtattggcaaatcgggtgcacagcccgccaaaaagagactcaatttcggtcagactggcgactcagagtcagtcccagaccctcaacctctcggagaaccaccagcagcccccacaagtttgggatctaatacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacagcaaccatctctacaagcaaatctccagccaatcaggagcttcaaacgacaacgactactttggctacagcaccccttgggggtattttgatttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgaggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 5275 - protein, 735 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRLLEPLGLVEEAAKTAPGKKRPVEQSPQEPDSSAGIGKSGAQPAKKRLNFGQTGDSESVPDPQPLGEPPAAPTSLGSNTMASGGGAPMADNNEGADGVGNASGNWHCDSTWLGDRVITTSTRTWALPTYSNHLYKQISSQSGASNDNDYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSEDNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 5276 - DNA, 2208 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagttccaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtcccagaccctcaacctctcggagaaccaccagcagcccccacaagtttgggatctaatacaatggcttcaggcggtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcttcaaacgacaaccactactttggctacagcaccccttgggggtattttgactttaacagattccactgccacttttcaccacgtgactggcagcgactcattaacaacaactggggattccggcccaagaaactcaacttcaagctctttaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtattacttgtctcggactcaaacaacaggaggcacgacaaatacgcagactctgggcttcagccaaggtgggcctaatacaatggccaatcaggcaaagaactggctgcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggttatgattacagacgaagaggaaatcaggacaaccaatcccgtggctacggagcagtatggttctgtatctaccaacctccagagaggcaacagacaagcagctaccgcagatgtcaacacacagggcgttcttccaggcatggtctggcaggacagagatgtgtaccttcagggtcccatttgggccaaaattcctcacacagatggacactttcacccgtcccctcttatgggcggctttggactcaagaacccgcctcctcagatcctcatcaaaaacacgcctgttcctgcgaatcctccggcagagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacactaatggcgtgtattcagagcctcgccccattggcaccagatacctcacccgtaatctgtaa

SEQ ID NO: 5277 - protein, 735 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPAAPTSLGSNTMASGGGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKKLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDTNGVYSEPRPIGTRYLTRNL

SEQ ID NO: 5278 - DNA, 2214 bp, Artificial Sequence; identical to SEQ ID NO: 5268
  Description of Artificial Sequence: Synthetic polynucleotide

SEQ ID NO: 5279 - protein, 737 aa, Artificial Sequence; identical to SEQ ID NO: 5269
  Description of Artificial Sequence: Synthetic polypeptide

SEQ ID NO: 5280 - protein, 736 aa, Artificial Sequence; identical to SEQ ID NO: 5093
  Description of Artificial Sequence: Synthetic polypeptide

SEQ ID NO: 5281 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQRANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 5282 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDAFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 5283 - protein, 538 aa, Artificial Sequence
  Description of Artificial Sequence: Synthetic polypeptide
MRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTKTNFSGYRKNWLPGPMMKQQRFSKTASQNYKIPQGRNNSLLHYETRTTLDGRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 5284 - protein, 736 aa, Artificial Sequence
  Description of Artificial Sequence: Synthetic polypeptide
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVHIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTNKNFSGYRKNWLPGPMMKQQRFSKTASQNYKIPQGGNNSLLHYETRTTLDRRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 5285 - protein, 736 aa, Artificial Sequence
  Description of Artificial Sequence: Synthetic polypeptide
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTKTNFSGYRKNWLPGPMMKQQRFSKTASQNYKIPQGRNNSLLHYETRTTLDGRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 5286 - DNA, 2214 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctcctcgggcatcggcaagacaggccagcagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataaccttaccagcacggtccaggtcttcacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtttggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 5287 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEQSPQEPDSSSGIGKTGQQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTVQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 5288 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 5289 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLQGDTSFGGNLGRAVFQAKKRVLEPLGLVEEGAKTAPGKKRPVEQSPQEPDSSSGIGETGQQPAKKRLNFGQTGDSESVPDPQPLGEPPATPAAVGPTTMASGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLSFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 5290 - DNA, 2181 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcacaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgcacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactattggggcttcagaccccggtctctcagagtcaaaatcttcaacatccaagtcaaagaggtcacggtgcaggactccaccaccaccatcgccaacaacctcacctccaccgtccaagtgtttacggacgacgactaccaactcccgtacgtcgtcggcaacgggaccgagggatgcctgccggccttccccccgcaggtctttacgctgccgcagtacggctacgcgacgctgaaccgagacaacggagacaacccgacagagcggagcagcttcttttgcctagagtactttcccagcaagatgctgaggacgggcaacaactttgagtttacctacagctttgaagaggtgcccttccactgcagcttcgccccgagccagaacctctttaagctggccaacccgctggtggaccagtacctgtaccgcttcgtgagcacctcggccacgggcgccatccagttccaaaagaacctggcgggcagatacgccaacacctacaaaaactggttcccggggcccatgggccgaacccagggctggaacacgagctctggggtcagcagcaccaacagagtcagcgtcaacaacttttccgtctcaaaccggatgaacctggagggggccagctaccaagtgaacccccagcccaacgggatgacaaacacgctccaaggcagcaaccgctacgcgctggaaaacaccatgatcttcaacgctcaaaacgccacgccgggaactacctcggtgtacccagaggacaatctactgctgaccagcgagagcgagactcagcccgtcaaccgggtggcttacaacacgggcggtcagatggccaccaacgcccagaacgccaccacggctcccacggtcgggacctacaacctccaggaagtgcttcctggcagcgtatggatggagagggacgtgtacctccaaggacccatctgggccaagatcccagagacgggggcgcactttcacccctctccggccatgggcggattcggactcaaacacccgccgcccatgatgctcatcaaaaacacgccggtgcccggcaacatcaccagcttctcggacgtgcccgtcagcagcttcatcacccagtacagcaccgggcaggtcaccgtggagatggaatgggagctcaaaaaggaaaactccaagaggtggaacccagagatccagtacaccaacaactacaacgacccccagtttgtggactttgctccagacggctccggcgaatacagaaccaccagagccatcggaacccgatacctcacccgacccctt

SEQ ID NO: 5291 - protein, 726 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNGDNPTERSSFFCLEYFPSKMLRTGNNFEFTYSFEEVPFHCSFAPSQNLFKLANPLVDQYLYRFVSTSATGAIQFQKNLAGRYANTYKNWFPGPMGRTQGWNTSSGSSTNRVSVNNFSVSNRMNLEGASYQVNPQPNGMTNTLQGSNRYALENTMIFNAQNATPGTTSVYPEDNLLLTSESETQPVNRVAYNTGGQMATNAQNATTAPTVGTYNLQEVLPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDGSGEYRTTRAIGTRYLTRPL

SEQ ID NO: 5292 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKSGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 5293 - DNA, 1803 bp, Bovine adeno-associated virus
acggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctag

SEQ ID NO: 5294 - DNA, 1617 bp, Bovine adeno-associated virus
atgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctag

SEQ ID NO: 5295 - DNA, 1173 bp, Bovine adeno-associated virus
atggcgctggtaagctggctggtggaacatggcatcacttccgagaagcagtggattcaggagaatcaggagagctacctgtccttcaactccacgggaaactctcggagccagattaaagccgcgcttgacaacgcgtcaaaaattatgagtctgaccaaatctgcctcagactatctcgtgggacagactgttccagaggacatttctgaaaacagaatctggcagatttttgatctcaacggctacgacccggcatacgcgggctctgttctctacggctggtgcactcgcgcctttggaaagaggaacaccgtctggctgtatggacccgcgaccaccggaaagaccaacatcgcggaagccatctctcacaccgtgcccttttatggctgtgtgaactggactaatgagaactttccctttaatgactgtgtggaaaaaatgttgatctggtgggaggagggaaagatgaccagcaaggtggtggaacccgccaaggccatcttgggggggtctagagtacgagtggatcaaaaatgtaaatcctctgtacaagtagactctaccccggtgattatcacctccaatactaacatgtgtgtggtggtggatgggaactccacgacctttgaacaccagcagccgctggaagaccgcatgttcagatttgaactcatgcggcggctcccgccagattttggcaagattaccaagcaggaagtcaaagacttttttgcttgggcaaaggtcaaccaggtgccggtgactcacgagtttatggttcccaagaaagtggcgggaactgagagggcggagacttctagaaaacgcccactggatgacgtcaccaataccaactataaaagtccggagaagcgggcccggctctcagttgttcctgagacgcctcgcagttcagacgtgcctgtagagcccgctcctctgcgacctctcaactggtcttccaggtatgaatgcagatgtgactatcatgctaaatttgactctgtaacgggggaatgtgacgagtgtgaatatttgaatcggggcaaaaatggctgtatctttcataatgctacacattgtcaaatttgtcacgctgttcctccatgggaaaaggaaaatgtgtcagattttaatgattttgatgactgtaataaagagcagtaa

SEQ ID NO: 5296 - DNA, 1833 bp, Bovine adeno-associated virus
atggctaccttctatgaagtcattgttcgcgttccatttgatgtggaagagcacctgcctggaatttctgacaactttgtagactgggtaactggtcaaatttgggagctgcctcccgagtcagatttgaatttgactctgattgagcagcctcagctgacggtggctgacagaattcgccgcgtgttcctgtacgagtggaacaaattttccaagcaggagagcaaattctttgtgcagtttgaaaagggatctgaatattttcatctgcacacgctcgtggagacctccggcatctcttctatggtccttggccgctacgtgagtcagattcgcgcccagctggtgaaggtggtgttccagaacattgagccgcggattaacgactgggtcgccatcaccaaggtaaagaagggcggagccaataaggtggtggattctgggtatattcccgcctacctgctgccgaaggtccaaccagagcttcagtgggcgtggactaacctcgaagagtataaattggccgccctcaatctggaggagcgcaaacggctcgtcgctcagtttcagcttgagtcctcgcagcgctcgcaagaggcatcttcccagagggacgtttcggctgacccggtcatcaagagcaagacttcccagaaatacatggcgctggtaagctggctggtggaacatggcatcacttccgagaagcagtggattcaggagaatcaggagagctacctgtccttcaactccacgggaaactctcggagccagattaaagccgcgcttgacaacgcgtcaaaaattatgagtctgaccaaatctgcctcagactatctcgtgggacagactgttccagaggacatttctgaaaacagaatctggcagatttttgatctcaacggctacgacccggcatacgcgggctctgttctctacggctggtgcactcgcgcctttggaaagaggaacaccgtctggctgtatggacccgcgaccaccggaaagaccaacatcgcggaagccatctctcacaccgtgcccttttatggctgtgtgaactggactaatgagaactttccctttaatgactgtgtggaaaaaatgttgatctggtgggaggagggaaagatgaccagcaaggtggtggaacccgccaaggccatcttgggggggtctagagtacgagtggatcaaaaatgtaaatcctctgtacaagtagactctaccccggtgattatcacctccaatactaacatgtgtgtggtggtggatgggaactccacgacctttgaacaccagcagccgctggaagaccgcatgttcagatttgaactcatgcggcggctcccgccagattttggcaagattaccaagcaggaagtcaaagacttttttgcttgggcaaaggtcaaccaggtgccggtgactcacgagtttatggttcccaagaaagtggcgggaactgagagggcggagacttctagaaaacgcccactggatgacgtcaccaataccaactataaaagtccggagaagcgggcccggctctcagttgttcctgagacgcctcgcagttcagacgtgcctgtagagcccgctcctctgcgacctctcaactggtcttccaggtatgaatgcagatgtgactatcatgctaaatttgactctgtaacgggggaatgtgacgagtgtgaatatttgaatcggggcaaaaatggctgtatctttcataatgctacacattgtcaaatttgtcacgctgttcctccatgggaaaaggaaaatgtgtcagattttaatgattttgatgactgtaataaagagcagtaa

SEQ ID NO: 5297 - DNA, 2211 bp, Bovine adeno-associated virus
atgtcttttgttgaccaccctccagattggttggaatcgatcggcgacggctttcgtgaatttctcggccttgaggcgggtcccccgaaacccaaggccaatcaacagaagcaagataacgctcgaggtcttgtgcttcctgggtacaagtatcttggtcctgggaacggccttgataagggcgatcctgtcaattttgctgacgaggttgcccgagagcacgacctctcctaccagaaacagcttgaggcgggcgataacccttacctcaagtacaaccacgcggacgcagagtttcaggagaaactcgcttctgacacttcttttgggggaaaccttgggaaggctgttttccaggctaaaaagaggattctcgaacctcttggcctggttgagacgccggataaaacggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctag

SEQ ID NO: 5298 - DNA, 4694 bp, Bovine adeno-associated virus
gtggcactcccccccctgtcgcgttcgctcgttcgctggctcgattgggggggtggcagctcaaagagctgccagacgacggccctctgggccgtcgcccccccaatcgagccagcgaacgagcgaacgcgacaggggggggagtgccacactctctagcaagggggttttgtaggtggtgatgtcattgttgatgtcattatagttgtcacgcgatagttaatgattaacagtcatgtgatgtgtgttatccaataggatgaaagcgcgcgaatgagatctcgcgagacttccggggtataaaaggggtgagtgaacgagcccgccgccattctctgctctggactgctagaggaccctcgctgccatggctaccttctatgaagtcattgttcgcgttccatttgatgtggaagagcacctgcctggaatttctgacaactttgtagactgggtaactggtcaaatttgggagctgcctcccgagtcagatttgaatttgactctgattgagcagcctcagctgacggtggctgacagaattcgccgcgtgttcctgtacgagtggaacaaattttccaagcaggagagcaaattctttgtgcagtttgaaaagggatctgaatattttcatctgcacacgctcgtggagacctccggcatctcttctatggtccttggccgctacgtgagtcagattcgcgcccagctggtgaaggtggtgttccagaacattgagccgcggattaacgactgggtcgccatcaccaaggtaaagaagggcggagccaataaggtggtggattctgggtatattcccgcctacctgctgccgaaggtccaaccagagcttcagtgggcgtggactaacctcgaagagtataaattggccgccctcaatctggaggagcgcaaacggctcgtcgctcagtttcagcttgagtcctcgcagcgctcgcaagaggcatcttcccagagggacgtttcggctgacccggtcatcaagagcaagacttcccagaaatacatggcgctggtaagctggctggtggaacatggcatcacttccgagaagcagtggattcaggagaatcaggagagctacctgtccttcaactccacgggaaactctcggagccagattaaagccgcgcttgacaacgcgtcaaaaattatgagtctgaccaaatctgcctcagactatctcgtgggacagactgttccagaggacatttctgaaaacagaatctggcagatttttgatctcaacggctacgacccggcatacgcgggctctgttctctacggctggtgcactcgcgcctttggaaagaggaacaccgtctggctgtatggacccgcgaccaccggaaagaccaacatcgcggaagccatctctcacaccgtgcccttttatggctgtgtgaactggactaatgagaactttccctttaatgactgtgtggaaaaaatgttgatctggtgggaggagggaaagatgaccagcaaggtggtggaacccgccaaggccatcttgggggggtctagagtacgagtggatcaaaaatgtaaatcctctgtacaagtagactctaccccggtgattatcacctccaatactaacatgtgtgtggtggtggatgggaactccacgacctttgaacaccagcagccgctggaagaccgcatgttcagatttgaactcatgcggcggctcccgccagattttggcaagattaccaagcaggaagtcaaagacttttttgcttgggcaaaggtcaaccaggtgccggtgactcacgagtttatggttcccaagaaagtggcgggaactgagagggcggagacttctagaaaacgcccactggatgacgtcaccaataccaactataaaagtccggagaagcgggcccggctctcagttgttcctgagacgcctcgcagttcagacgtgcctgtagagcccgctcctctgcgacctctcaactggtcttccaggtatgaatgcagatgtgactatcatgctaaatttgactctgtaacgggggaatgtgacgagtgtgaatatttgaatcggggcaaaaatggctgtatctttcataatgctacacattgtcaaatttgtcacgctgttcctccatgggaaaaggaaaatgtgtcagattttaatgattttgatgactgtaataaagagcagtaaataaagtgagtagtcatgtcttttgttgaccaccctccagattggttggaatcgatcggcgacggctttcgtgaatttctcggccttgaggcgggtcccccgaaacccaaggccaatcaacagaagcaagataacgctcgaggtcttgtgcttcctgggtacaagtatcttggtcctgggaacggccttgataagggcgatcctgtcaattttgctgacgaggttgcccgagagcacgacctctcctaccagaaacagcttgaggcgggcgataacccttacctcaagtacaaccacgcggacgcagagtttcaggagaaactcgcttctgacacttcttttgggggaaaccttgggaaggctgttttccaggctaaaaagaggattctcgaacctcttggcctggttgagacgccggataaaacggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctagcccaattctgttgcataccctcaataaaccgtgtattcgtttcagtaaaatactgcctcttgtggtcattcggcgtacaacagcttacaacaacaacaaaacccccttgctagagagtgtggcactcccccccctgtcgcgttcgctcgttcgctggctcgattgggggggtggcagctcaaagagctgccagacgacggccctctgggccgtcgcccccccaatcgagccagcgaacgagcgaacgcgacaggggggggagtgccac

SEQ ID NO: 5299 - protein, 390 aa, Bovine adeno-associated virus
MALVSWLVEHGITSEKQWIQENQESYLSFNSTGNSRSQIKAALDNASKIMSLTKSASDYLVGQTVPEDISENRIWQIFDLNGYDPAYAGSVLYGWCTRAFGKRNTVWLYGPATTGKTNIAEAISHTVPFYGCVNWTNENFPFNDCVEKMLIWWEEGKMTSKVVEPAKAILGGSRVRVDQKCKSSVQVDSTPVIITSNTNMCVVVDGNSTTFEHQQPLEDRMFRFELMRRLPPDFGKITKQEVKDFFAWAKVNQVPVTHEFMVPKKVAGTERAETSRKRPLDDVTNTNYKSPEKRARLSVVPETPRSSDVPVEPAPLRPLNWSSRYECRCDYHAKFDSVTGECDECEYLNRGKNGCIFHNATHCQICHAVPPWEKENVSDFNDFDDCNKEQ

SEQ ID NO: 5300 - protein, 610 aa, Bovine adeno-associated virus
MATFYEVIVRVPFDVEEHLPGISDNFVDWVTGQIWELPPESDLNLTLIEQPQLTVADRIRRVFLYEWNKFSKQESKFFVQFEKGSEYFHLHTLVETSGISSMVLGRYVSQIRAQLVKVVFQNIEPRINDWVAITKVKKGGANKVVDSGYIPAYLLPKVQPELQWAWTNLEEYKLAALNLEERKRLVAQFQLESSQRSQEASSQRDVSADPVIKSKTSQKYMALVSWLVEHGITSEKQWIQENQESYLSFNSTGNSRSQIKAALDNASKIMSLTKSASDYLVGQTVPEDISENRIWQIFDLNGYDPAYAGSVLYGWCTRAFGKRNTVWLYGPATTGKTNIAEAISHTVPFYGCVNWTNENFPFNDCVEKMLIWWEEGKMTSKVVEPAKAILGGSRVRVDQKCKSSVQVDSTPVIITSNTNMCVVVDGNSTTFEHQQPLEDRMFRFELMRRLPPDFGKITKQEVKDFFAWAKVNQVPVTHEFMVPKKVAGTERAETSRKRPLDDVTNTNYKSPEKRARLSVVPETPRSSDVPVEPAPLRPLNWSSRYECRCDYHAKFDSVTGECDECEYLNRGKNGCIFHNATHCQICHAVPPWEKENVSDFNDFDDCNKEQ

SEQ ID NO: 5301 - protein, 736 aa, Bovine adeno-associated virus; identical to SEQ ID NO: 5285

SEQ ID NO: 5302 - protein, 600 aa, Bovine adeno-associated virus
TAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTKTNFSGYRKNWLPGPMMKQQRFSKTASQNYKIPQGRNNSLLHYETRTTLDGRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 5303 - DNA, 180809 bp, Homo sapiens
gggaggcggggctgctacctccacgggcgcgccctggcaggaggggcgcagtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagtaagtgccttttcttttgctgcttctgtggggaggggaggagaagccctcggtctttcgcccgtgctcgcctcaaccgccacacccacctgtgtctattttcacatctcggttctggaaccctgtattacgccacctggaaagaagagaggggagaagcttgaccgggtggttccagcaatgggaggaagaagggctggaagcgtagttatttcgatagctgggcagctcctgtgcggttttgactctgtgggtttgctgccaggttctgaaactgtggaaaggaagggtagcaatgcctggtggtttactgtcttttatttctgtttacgctagcagagttgttagatggacttcaattcaaggggcagctcacattttttacgagcaaaaagcatgtgctgtatttcccatctgcaaagctgagcgtgcagaaccagcttagcagatacaacctgtggggacagaaaagaaccccgcaccccttaagagcacacaaacacaaataattgacaggacagctctgcccctatttctcagcgcagattatttatttattttttcgaataagcactttatagtgaaattcagaaaagatgcagaatccttttaactttttatcgaattcaacttgggaaactcatttacttttaggaaaaaatggatattttcgtgccttatattcaagacaaaaatcagaacaagaaactagaaacattaatgccagtttttgtgattatagtaaacatttcactcattattttagttttttttttttaagttggagcgttcatagattatatctactctgatgttaagagcaatttacatgagaaacttaggggggtttttaagaagctagtgtcagtaagataaaagccaaatcaaagtaagctttcaaggaagtgatagcttgtcagttactgaataggaagtcagtgttgggaagttcagttcttttcagaaacatatttattattcttttctatttcttcttccctgtagacaagataaagattttctttctctttctttccttgttatttaaatatattttataatttttgctttaacatcaatataaacctattttatataaactgcaaaccaaatccaattattaaactgttcattttattgcaaattcttcagattttttccactatttaaaaaagtttataattttttcttataattatggtgagattttttaaaaattattgattagtttgaaagctagtcttatctgatccctgtgtcgcaaattttcatgattgttagactagcttatcaacaacaaaactctagacagaatatggtatttgatgtaaagaagaatgtgccctctatttaggcaactgatagtttggcttaagacaagttttttaaaattttgtagaggtttaaaaggaggtttccttaagtaagccactgtgcagttgtgggactcagtgatgtgtttttacagtgactggatatatgatatgccttgattcctatggtgcagggctaggctcacagagtacctgatgcttctacagaagaaagatgagtcaggtctggctctctgccaaaagcatcttgggcctcctttcccctagggcctgcatataatcatgggagcccttctgtggtaatgcttctatgtttttactacctgttgctgtgctgagtttcagaagcaaaatagataaacaaataaataaattcagaagagcaatcagtagggttctatttatttaatataatcaacccactttctctgtggcaaggaaaaaagtagaatttttcattttacatgaataataaaatctattttttatccaatttctattcctattagttatgcaaaagagtgtgaagtgctagaaggatttatatggtacttttctaagacaagtcatgatcttgtaaaagagcttaaagtttattgatgtaaatggaacattctagatgtcataatgataataatttatgactttccctaaaactctgtctcagattctttcctcccatcttcattatctgaataaatgccttcaccatccaagtattgaaatcacctttgattgctctcttccttattactccatttcagccctttccagcctgtaagtagatctatcaatcttatctcccaaacttatttctatttcatcatacgtctcagatgcctctcattcaccctcttttctgtatctacacggccaccaaattagttcaggtcatcatcataatttacttggaatcctgccacagcctccatatcaatctctccacttctgtaattttctcccctgcaattcattctctatacaaagcaataccatcctgtctcccctaacaaacattggctcacaactgcatttaaaaaaaaaaaaaaagaggaagaagaagaggagaagaagaaataaacatggcaacacagagaccaattagcaacaacagtaaatgcctttcctcagcatatggtttactctctgttctgtcccttctctccaacctcaccagaacctattctcttctcattaaggtgctcctgcccaggtcgtggctaaaacacatgaaacaatagcactctttaaggccttttcaaatgctgttcccaatgcctgaactctatgcgtgcttactccttcttaaactttaaatctcaactcgaggtttttttgttttggaaagatcatttttgatcatcttgttaaaagtaggttgtcccgtgttggtcttgatgttggaaccttgtttctttcatactgcttgttacagcatgcaggtattttgtgaatttgcataccaaatactccaagggaacccagactatgtcttcattgttgacttagcttccagaatagtgcctggcatcaagtagtagggggttcgtagatatttatataaataataaaatacaaaaatatggattcttccagaataaagcatattaaccctggaaacatgaattttgtgattctattttttatttgtcaagcatttagtatttttacaatatcatggtatgatattgaggaggtaaaattaaaatatcctgagatgtattctctcttttatcagtgtaggtgataatgtacttaaaggtaagtaatttgtaatgcattcttagaaaggcagtgaccacaaatgtattaaaatatattttaagaaaaaattggattgcataaactaatatggttataagtgactccaaatctaaaatgataaccttgttaggtttaaatctgtatcatctaacagaaatttgagggccagtcaatagtcactgactatgaatttaaaatattcttttaaaataaacatagatgcttatgtgagctcagttgatagaaatgtagtcagatgaggcggaggccataagttaggtttccacacggtctaaattgatgtttgccccaggtacaaagggcacattatccaaatatttgaagcattctctaaggaaggttcagagaggcaatgtgggcttatccatgaagacccatcactgttattagagtggaagtaaggactgcaaacttcatgctcataaatgattgtgtcattttcatactagaattttaccacacacacactcacactcacacacacacacacacacactttgtatggtgatttgcctcccccctttatttttgcagactatgcttaaagatattaaacaaacaactagttttgctattaacatttggttgaaaatttagctttcaattaggtgacaaactgattaatgatttttttatgtagcaaatggccagccacagatttttggtaaataatttggttaccacattacatcttgaaggactaaattatttcactaattgtgagcagggatttttaaaaatttgctctgaagaggacatattgtggatgttgtattggagggcatctgtgtactaattgaagatggtccttcatattacacatcacaaattagctaatttattctttacagaagtattatgacatcttcctttagaactgtgtagagttagattaccacttgagaggcaaggtcatattaaaatagatattataaaattgtataaaaatattttatatgaggatttatgagagcatccagagaatgtgggtagaatacttttgtggaatatgagataacaattttggtgtcctgccattctaaaaaatgaaatttcttcattgaaggtatcacttaccctttcctctgccttgctggaaggaaatggctttaggcaaaagaaaaagccatcagctcttggcagctaaaggtggaatgaagtttggaggaatgaaacccttctgggtggtgaggaaaaatgccaggccatgataaagtggggaaggaagaggggaatgccttgaacagtgccagtaagcataatctgccacagacaagtttgaattgacatatgtagaactgaattattctatatctttttagttctatagagaaaaccgttctttccacgtctctttttaaaataacaacttactgtaagcaaaaaatatgttgttgttgtttctttaacacaggagatgaactatctttagattttttaaagtgatataacatggagccaaaaatgccatatattactgttgaaacctaacgttactttaactgtaatttccttgctattcattttatgatttcctcttgttatgtcaagtgttagagagactgctattactgatcataaatttctttaaaatgtctccttggattttttacaaagctttctgaatcatttatcaaaatacaataaagctctaattgcacctaggattgttcacttggaaatttagaaagagtgtgtacatttacaattaagttagcatcctgccctgcaatgaatgccctttttctttttttttttccttcttctctcctacatctcatcttccaaatgtttgatatgtacgccagtaaggcaaattttactccacttttaggtcaaactattagtacaaataattggaaaattgagcctctaaagaaagataaataagattagaagcatgcattaaaatataagtattaaaaacattcccataagatttttaataaaaattttatgtgctatatgcacacctagactccctgtattatctgatttttaaagattcttttttttttttattttttatttttttgagacggagtctcgctctgtcgcccaggctggagtgcagtggcgcgatcttggctcactgcaagctccgcgtcctgggttcacaccattctcctgcctcagcctccgagtagctgggactacaggcgcctaccaccgtgcccggctaatgtttttgtatttttagtagagacggagtttcaccatgttagccaggatggtctcaatctcctgacctagtgatccgcccgcctcgacctcccaaagtgctgggattacaagcatgagccaccgcgctcagcccattatctaatgatgatgatgatgattattattattattattattattattattattattattattattttaactgggggtaatttcactggatgtggtatctgtcaacttttactagttgctcctacactatatgtttttaaatccaatgtaattattttaaaaatatgtcatcttcttgagagtctatactttagaatttgaaaaaagaagtaaatgtagatattcaaatccatgcagatgagtaaaacagggaaaaatgagaaaaatgtttcatgataataaaatattatgtcaggcacagctggtcacccctgcaatcccatcactttgggaggccgaggctggaggattgcttgatccaggagttctagatcagcctgggcaataaaaggaaaatctgtttctacaaaaaaattaaaatttatatttcatatattgatttaagctctactaaatgactattctttcaagtctaatagacagtgtatcttttagggctcagagtaaagataatttattgaggacattttgaataggatgaattaaatgctttattggtaagtgatgcctttatctgagtgattccttctaggtaaatattatgggaccaatctttgtaaatgatctttgcatggaacaaaatattataaagttgaagtgatgaatttgtttccctcttaacaaaatatgtattcttgttaccccatttacaaacttggctcatggtaattcaggtaggaaaaagggaagtggcctactcagggatcaactgggaataaggttcttataatcccatgagatcagctgacagacttttaggaatgaacacttgtagaacagctaggcagagaagtgcctttcaaaatttatattacatctctactatatttcagactgtaaaatatttttataaagtgttaaaagcacagataaataaatttgagttcaaattagtatagtgaaaggaagtttatttttcccaaatatttcctttactcagtatgtggtcttagtcaaatattaatttcttaaatattgctttcctgtaaattagtagtatttacttctaaggactatattatatgttatatatagagtatattatatattaggagatatatatgtatatacatcgtaatttgttttttccaaaacagccactttagtgtcttacacatgataagtagatatgagtagatgttcaataatggtatctaggcatttaataacttagaatattataatcaaaatgcattcttttttttttttttgagaccgagtttcactcttgttgcccaggctggagtgcaatggtacgatcttggctcactgcaacttccgcctcccaggttcaagcaattctcctgcctcagcctcccgagtagccgggattacaggcatgagccacctcgcctggctaattttgtatttttagtagagataggatttcaccaggttgggcaggctggtcttgaactcctgagttcaggtgatctgcccgcctaggccccccaaagtgctgggattataggcgtgagccaccatgcccagcctctttttttttttttttttaattaagtttcaaggtacatttgcaggatgtgcaggttttttacataggtaaaggtgtgccggtttcactctgttgcccaggctggagtgcagtggtacgatgttggctcgctgcaacctctgcctcccagattcaagtgattctcctgcctcagcctcccaagtagctgggattacaggcatgtaccaccatgcccggctaattttgcagttttagtagagatggggtttcaccatgttggccagactagtctcgaattcctgacctcaggtgatctgcccacctcggccttctaaagtgttgggattacaggtgtaagccactgtgcaaggccagcaattatgctgttacaaggaaaaatacatacggaaaagtttacatcttgctaacattactgataatattaatgtaacagtcttatgtatggacgtctccttaatgctaactgagcagtttgttaagggattttcatatgctccgtttaaatcctcatgaccaccatttgaggtgagaacactaaggctcagaaattacctaacctttccaaagactcacaatggttactaaacttgaataacatacacatttcttttataggaaagaaatcttatatattccaagaatacgtttgcacataccccacacagatatacctggtggttacgctaccaagcattctatcaaatatgtttaacccttaatggagctaaaataaaattacatttgcaatcaaacatactaaatcatgtaattacagctaatagaaaacaacaaaaaaagaaagatggatgactgtttcaattttcttcttggacaccaattcctgaggggtatattgtgttaagtcaaaatagagattttggtggaagtttgaagacattatgaaaagagtacctatgcatttaaagtgtttttgaagttgttttataggttgaatgacttcactttcctggtctaggagtattattgcactactgtgacttgactttgctatgattcgcatattttgttttaacattaaaaaactgaaatgggaaaaaggccttccccaaggtagaaaagatttgaaaaaagaggaatggtgtaattaaaagggaaatatgtataaaatgtctagggtgggccaggcgcggtggcttacgcccgtaatccagcactttggaaggctgaggcaggctgatcacttgaggtcaggagttggagaccagcctggtcaacatagtgaaaccccatctctactaaaaaaaatacaaaaactatccaggcatggtggccagcacctgtagtcccagcttctcgggaggctgaggcaggagaattgcctgaacctgggagatggaggttgcagtgagctgagatcgagccactgcactcctgcctgggcaacagagcgagactcagtctcaagaaaaaaaattaaaaaaatgtctaggatgaagtttattctgaaatggagaagaaacagggaatgaagttacacacgttgagatcctggagctagcagatggagaagtatgaaaagcaaagtgatcttgtgcaggataagatgatggtgttcattggaagtatttatatatcttggaaaataaaaatttagatattctatattggaggagtacaaatatttagagcatcacaaattgatacacacaaatgaaacctaaatcacagtacttattgtcatgaagactcaattatctaagtcagttaaattgtctaacatcagtaatgcaagaagttgacttttaagggttttaaaacagttttggaaaactaatttattttacattatgtttataataatttttgcatgcaatttttttaaatatctattatccacttagatactgtactttgggatataaaaaccatgggaaatttggcccttgagttctatgatacgtctcaatctattttagtgatttgtggattggtagcttatcctctagactaagtggttaaggttttatcagcactgcaatgagataatcatctcacacctgttaagatggctgttataaaaaagtgaaaggtgttgttgagaatgtgaagaaaatgaaagcattgtccactgttggtgggaatgtataatagtgtagctgctatggaaaataatatggaagttcctcaaaaaattaaaaatagaactaccatatgatccagcaattgaaatcagaatctcaaagagatatatgcacttctgtgtttactgcagcattattcacaatagcaaaaatatgaaaacaacccaaatgatcatcaacagataaaagagtaaagaaaatgtggtctgtatataaaatagaatattatctagccttaaaaaaagaaggaaatcttactatttgtgacagcatgcatggacctagaagagacatgctaagtgaaataagtaaagggacacgaaaacttttgacagtgacagatatgcttaacaggtagactggcagataagaaaaaacaaagttaaagctgaaatttccaactgatttatcttagcctagggattaatcattagatccggtctagttggcctccaaaatgtgtaggtcaggagttggcatccaagttggtattggtgccattgaggtttgtagggagggaagacctggcagagatcccaagggcagtggtaagcggctgctgagtccctccaggccagttccaagaactcacaacctcactcctctcagcatttatactcttcctggaatttaaaagcaattccttctttccttccctctttcttttttccctctcttccttcttcataaagttttattgtagacatcagatatagcaatgaacaacacatggagatgtgacgccgattttaagagataatgaagagataaatattcgccactatccatcattgtaccataagatatgctgtgaaaaacaataaaacaggacagagaattgagagaaggaggtattatttaaagtggtctgaaaaattttatacagggtatttgagtagagacatgaagtaaatgaaaaactaagggagctagctaaacaactgaagaatcattctagtcacaaaaaacagcaattgcaaaagccctaaggcatatttgatgtatttaaggagaagcaagaaaaccagcatggttgaaatacagacagcaagattgaaagcagaagatgagggtttttcttgattttgtagggattactaacctgcgtcgagggctgcgtgataaaccaatgctaaaattaccagcatgggtacaactttggaaagggatgagtgtgctcttttttaactggatctctttctggacatgggtaacataaaaccagaaaaaaatgtttgagaagtttctaatttctatacaaaaataatgtttttgtctttttttgtgatttagatgtaaatgtatatgtacatgcatgtatatgtatttatgtactgatttactatttatgtatatgtaaatgtatttatatttaaatgtcctatattctcttcctgtctgtaatggattggattcttggaacctcttactatttggggcagggggcagggctaataagacaaagattacaattgagagtaactttaaatgtttgcattttggaaacttaatggtgggagtacagtaatattttgtatatttcgatcaattttgatgtttattatatgattatttctcatgaaatagtggtactgcatagatataaatgactactgcctagcaaaacagataccaaggagacaccgcatgttgtcagggttgaccggttgctaactgctgtgattttgttctcttactgactctttctgccttacggatctcaaaacacgctagtgaatttaaaaatttatattttggtaaaatatatataacaaaatttaccattttaaccatttcaaatgtacagtttagaggtattaagcacattcatgttgtacacgatcaccaccatccatcttcagaacattttcatcattccaaacaaaaactcggtaactattaaacaatgactccacactcctctcttcccctatcacccagtaaccactattctactttctctatgaatgtgactattctaggtacctcatgtaagtggaaccctatagcatttgtcttttcatgtctggcttatttcacttagcataatgttttcaaggtgttcatccgggtcgtagcatatatcagaattttattcatttttaaggctgtgtagtattttattgtgcatttatacacattttgtttatctgttcatctgttgatagacatttgggttgttttcactttttggctactgtgattagtgctgctatgaacattggtgtacagataactacatgcgtcccttctattaattgtttaggatgtataccctaaagtagaattgctggatcatgtgatatttctgtttaattttttgaggaaccaccacagtgttttccacagcagctgcactattttatattcctatcagcaatgcacaagggttacaatttctccacacccttgtcaatgtttcttttccttttttttttttaaacaataaccatccgaccaagtgtgaagtgatattttattgtggttttgatttgcatttcccaaatgatcggtgatgttgagcatcttcccatgtactgattgactttctttggaaaaatgtcttttcaaatcctttgttcatttttaatctgcttgtttattttttgttgaggagtaggaattttttacatattgccaatgttaatcccttatcagatatatgatttgcaattattttctcccatcatatggattgccttttcactttctagtagtgttctttgatgcacaacagtttcaattttgacaaaatccaattcagctctttttttcttttgttgaccgtgcttttggttccatgtccatgtgccaaatctaatgtctcgaagatttttccctatgatattttcttagaaatttacagttctaactctgacgtttaggtctgtgattcattggtgattttttaaaaattcctatataattcgtagactctaagagagtttccagctttcccatacccattgtccccagagatctggtttttagtctgaatgtgccttactctgaacatgtgccttccatttcaagaactcccatttcattttgttttgttctgttttttcttttataccagtattaaaacttttgagttgttgtataaatatactagcaatttaggagaattcctgatgggaaagaatatccttgcctagctagttaatgaatttagggacccttcattttctaatcctagatatgattaaatcaaacaaggattcattgtgctgtagttgtaatccacacagaccattttacaaggctttgcacagagaaggtgcttaatacttgagtaaacaaattgaattaatgagtaagaaagaaaagctatcttgttttctcaacggtcaagtagatcaatgatttctactatttagaatcttagatttattttaataaagcaagttcaaaaatctcctctctctgttaatttttagtaaagtcacttatttttcactcagttttgttaaagtgttttcagaagagtttgttaccgaaaactgaagttttaaggttagtgtttataccacagatatttcttgtttttagacaatccttgtggaggttaagtcccctaggcaataccttttcccactggggagttacaagcaaatgaaaaatggtgactatttatggaaactccaggtcactaagtaaattttgcattttcatgaaaatatgacatatggacatttaaaaaaatgaacaggtcaattcatcagttagaataataaaaagaagtctgtaaataaaagttaagcacctttgtcattgaattgttgtgaaccgtttttgcctatgcacttgctttatctcagaatccaagcctcctggtcaaagttatattcctaataaatttaaaaataataatttaataattttaattccttctggaatataaatttgatcaggagtcttggattctgagataaagcaaatgtttaggcaaaacacttccttctggaatataaatttgaggaaggataggaattattttcttcctattcatttgtgatcctgtgattgttatctaatttggaatattcttcatgactccaatcctatttatatctgtgaggttctgaaaattctgccccaaaatggcagaaagtaagaaatactatcacacatttaattcacccttaaaaaaatagccataccctttatctttgaatatatttttaacaacaacaacagaaagagaatgcattttaaacaatatcacatgagtttcatcatattcccagattatggtgagggttcctagataccttgccataatcacagcctttagttccaagagagagcagagaaataagaaacacaggaagtcatatctatgaacatgttagtttgcaaaaggtttgttagtaaactcatgttatttataccatagtactttaccatctccagatgaatttccactaaataaactgttcctttagactcctcaaaccagattacccccttcctttgctaatatagattctcaaacaatgtcttcatcaaaaatcttatgagtagatgtcactagttttgacaatgtccacaaatgttccaaagaatactttggcatgcatgcttcttaactcacttattttgatattgaattaaagggcttttaacaattcctgccccatcaggaatatttcatcagcagctgttactgtgcttggattttgccttcttgaatgaatacctagtcttttctcactttagcattaagttctggagcatccgctgctaatgaaaaatcctctgactcatgctagagcattttcatttttttaaaaaaacaatgttccttgtatcttgctggctattgcctaagctcattattttaaacttttgcataattctgctcagtcctagagggtcatcattactgtcaatgattaaacttttatgcacttgccacatttattattttcttactttcgatcattttattatttttctttggttcccatgatattccaatgtttttgttattaaatctttcaacatcctcggtgtgttcagtgtatccacatttatcaaacctgatggatttaagaatttatataaccttgaaagcaaggcccacatcctgtagacactgaataaactaatgaactttgtattggcaggactaaaatggctgtgtgtggcatatattgccacctgttggtagaaggcaatgtagtcttggttttgctataagcatacattttagtctttaaaatattctgagttgaaagctccctaagaagaaaaggttttgtatatgcaatacaaaagcttttctattataaagtaagcaaatatattctcgttcctaagaacattagctttaggtatacaaaatcaacttagaagaaagttgctaaaatcactaataataacagttacaatgtattgtgcactgaaagtgtaacaggaaatgtgctaagttattaaaattcagtgtctaattttttccactaaaataaccttaaaggattatcattttcagctccggtttgctatataagaactgagctttagagaagttaattaaattccccaaggacataagctagtaagcagtagagatgggatgtgaacccatgcctctctcactctggagccatgaatttaacaactgggttatgctgtcttactattttactgcagatctatattttaaattaaagccataaacatgtttggcaagataaaacataggtaacaaatatactccacataagattttcgtaaggttttgtgtttattggccaactcatggcttattatttaaaaatttcagtctgtatagggaagaaggataataatcttgctgttatttatttagcctaggcactgtggtaggcactttaccaaaaccatttctattctacatgataactttataagacagatatatttctctctttcatttatggggaatttgcataatgctgcagagctaattatatggaataaacaggaaattcaaacctaagtctgcctggtgccaaagttattactatgcactttctcctaaatcatgttgatgttttgagggaagtggatacatgtataataatattggaaatacattttctctctaattatttaaataagggtatagaacctgttctgcagccataagtctgtgataattttgtgctctcaataaagtcttaactaacagagagatgggatttaacgtgaactaagaagtattttctgtcttcctttatacatgctgtacagataagactttatgaattttttattaaaacgttcagatatgccagcaaatgttgacactaatcttaagttttcccagggtaatacacttcttaagattataaactttaatttctttttttttttttcttttttttttttttttgagacagagtttcgctcttgttgcccaggctggagtgcaatggcccgatctcagctcactacaatccacctcccgggttcaagcagttctcctgcctcagcctcctgagtagctgggattacaggcatgcgccaccatgaccagctaattttgtatttttagtagagacggggtttctccatgttggtcaggctggtcttgaattcctgacctcaggtgatccgcctgcctcggcttcccaaagtgctgggattataggcgtgagccaccacgcccggcaaactttcatttcttataaacttgaggaatactatattttaaaaggctatacataagactaacttctatcttaataataaaataataaatataatataaatgattattacagggtattatgaaatacccaaatcacaatattttaataatcatagaatttagaaatagtccctatcagttgtctgaatataaaattatcgcatatacagcttaatttgttttgcataccagttgttcaactactataaaatgccataaaattgaatgattttaggacatgaaatattgaactactcttgttgaagttattaaactgatttgccatctaccaaattaagcatttctaagaaataataattattttaagaatttatttacatgattaacataatgttacttatgaaggatgcaatggtaagatttcagcaatcaggcaagtatttaatgaaaagtatttggtttcatatatattgtatttgatttcatatatattgatacacttaacattagaggttctaaaatgagtagccagcctgcctgtttttcttgtgatattatacttggcatactttgtttttataatctaaagaagaggtattaaaaaaagagtcagagtgcttaccattggcagttccttttaaccttttaatttataaagacattgcaatcccaatgaaaataaaaatagaaattttcccatttggaattagataatctggatctagttgggaaattgtacacacataaaagagtaatatctaatagcaccaaccctaatacataatgttattttatgcaaatagggtaattaaaatagtatggtgacctacatagatagttcattggaagaaaatacgatatccagaaatagacatagttacatatgagaattataaaggtagcatcttaaataggttgaaagaaatattatttaatagttatcattgggacacctgggtagtcatgtggataaaaataaattcagattactgctttgccacctaacccaagatacattttagtggaatcaaatatttaaaataacatacaaaccacaaaactgctagaagaaaacatgtgaaggttttgttttcttttttcttttcacctgagatggataatatatcaatgtcattacaaggtttgagggaggaatatctcacatatgcatgtgaaaacccagtcatcacacttatgaagtacttgaagtagaaattattttctaagataatataaaacacaggagccactggagaaaggattggtgaattcaatttaattaaaatgtagatgcttttaaaagataaactaccataaaccaaaagaaacaaaaacagcaaacttacaaaaatatttgtattgtataccacagaaaaaaagctaattttattattttgttaagagttcctaaattaataaaacactgatagtctattaaaaaagtggacaagactacatacagacagagcacagaaaaaaaagcacaaatggcatctgaggatatgaaaagatccctgacctcactcacaaaagaaaatgcaaactaaaatgataagaattaagaagttttcggccgggtgtggtggctcatgtttgtgatcccagcactttgggaagctgagatgggtggatcacatgaggtcaggagttggagaccagcctggccaacatggtgaaaacctgtctctactaaaggtacaaaaattagccgggtgtggtggtgggtacctctaatccgagctactcaggaggctgaggcaggagaactgcttgaacccaggaggcagatgttgcagtgagctgagatcgcaccaaggcactccagcctgggcaatgagagagcgactccatctcaaaataaataaataaataaataaataaataaataaataaataaataaataaaagttttattccccacttattaggctcacaaagatgaaaaaaaatttatgaaatactttattgaaggtatgtgcaaacaatccctgacacattgtttggggagagcatggattgataggcctttatgaaggagttaccaatataccaataacctccttggtagtttcaaaaggtggcatctttccctgtttggtattggagacccaatacaagaaatgggaaagtgagcatcaagcaatgcaagctttattcgatggccaaagaatggagaagtgcaagtatggcgcacaagctaacttcttgactagtgaggagtgaggaaattgaaatagaaagtatatctaatgaagaagttggtcattaagagtgaggggaggaatgttcatgtcttttccagaaataggtggtgaacttcttggaaccagagtgccgccttcctttttgtccttttatggcttcttctggtcattgtcatggggattatcaactgtcatggcactggtgggggtgtcatttagcatgaaaatgagattataatgatgcctgaggtcttcttgaagtcctttagtcaactatcttggttctaagcaatctcagctgctctggttacaaatggaacattttacctgtttcttaaagatcagcagagttagggtaggatagaaattcagctatggccctgtaggcgttacactaggtaacaaaagagaattcggcaatattttattatggcaaattaaaaacgcacatacaattatgactcagcaatttcactctgaagcatttgtcttacaaataaaataccgtactgtgaaactattcaagagaatgtcctcacttataagtgagagctaaatgatgagaacacatggacacataggtgggaacaacacacactggggcccattggagggtggagggtggcaggagggaggggatcaggaaaaataactaataagtacttggcttaagaccttggtgatgaaataagatgtagaacaaaaccctgtaacacaagtttccctgtgtaacaaacctgtgcatgtacccctgaacttaaaataaaagttacaaaaagagcccacaaaagagtaggttaaaaaaagaaaaaaactaatgagaagataattattgtagctttgggaaacaacctaaatgttctacagtgtgggaatgactaaataatttgggtacagctgtacaataggactttatgaagctgctataaaaagaagtagctttatacatgctgatacagaaagatttccaagtctgatttttaagtgacgaaggaaggtatgaaacaatgtttatatagggtattatttgcatgaaaagaaaaatgaatagatgtatacatgctgataaaaccacatggatggatacacaaggggttggtactgtggttgtccacaggggaggaatttggatggctgggaaacattgaagagtgagagaattatttttcgttatacatacttttgagttttgtggctaaatttattcttcaaaaataaatataagaatgctatttatggggaaaaaatgggagtcataaacctgcaatttggacctaacttttcaacttaaaaatgttctgttcttggagttactaactgctctgatgcttaggatgataatcaaataatagttcctctaaaatatgtctggaatgaacttgaatgaatgaatgaatgaatgttttttgcaaaccattatgtgtgtaaaaatgtagagtattaatataaggtttatttagaatagagtcatctgcattaaagaaacttcgttatacaaaaatctaaataaaaaaatgttgtacagtagctctgaggaggtggatgacccaaacactgagaaaagaaaagaggcagaggctgagcaggatagttcagtttgaggtaaagaagcagcctcacccagcctcagacaagactccagggactgtgtgaaaaacctcattttggccaggcgcagtggctcacgcctgtaatcccagcattttgggaggccaaggcgggcagatcacaaggtcaagagatcaagaccatcctggccaacatggtgaaaccctgtcgctactaaaaatacaaaaattagctgggcgtggtggcaggcacctatagtcccagctactcaggaggctgaggcaggagaatcacttgaatccaggaggcagaggttatagtgagctgagatcatgccactgcactccagactgagaatctgtcaaaaaaaaaaaaaaatctcatttctaggcctatgtttcccagaaatatgtcatgaaaataaaactgccctcccaatgggaaaacatatatatgcacaaaaaggtaaatatttttaatgttaaagttactgcataattcctttaaagagtaattatatatttctattcatttttgaaaaccagttttagtaaagacaaagttaaaagatgacaaactggcaaaagaaaaaaaaaagaaatttttgtgaaaaggtatcaatatccttagcgtgtgcacacacacccacacacacacacaatcccttggcaaacaagaaaataatgaatatttcaatagaaaaaagatcaagagactaaagacactgaccaaagaagaactagaaatgtttcacgaaattcacattttagataaaaacgttttaaatatcaaattatgaagtttttttttaaatgactatacttaacattgtgggaaaatatatgcttacatgttgctaaaaatgatatacatttttatagcctttctggaaacattttgtcagtatgtatatatatataaaagaagacaggttgggtgtggtggctcatgcctgttatcccagtgctgccaagaggcagaggttgcagtgatggagtgagccgagatcatatcactgcactccagcctgggtgacagagagagactccattaaaaaaaaaaattagccagacatagtggtgcacacctgtagtcctagctacttgggaggctgaggtgggaagaacacttgagcccatgaggtttggaggttgcagtcagctatgattgcaccacagcctgggtaacagtaggagacattgtctctttaaaaaaaaaaatcagtaattttcttggaataggttaatttcatttatttttttctatgcttttcagttttctaaattttctcccaatgaaaatttgctatatttatattcaaccatattaataaccccaaattagtcacatgtgcaactttctgcaaataaatgtgtcttggatttaatggaaatgaaatcttttcagtatagcttctccctgttatttgcgtacaagcttcaaactgcataaactattttaatggcaaaaattaagttagggttaatcaaccatctaggattgtatctgtgcctaggtttctaaaacaattaaatacttgatcgctttgttggatgttcaaagatttggcaatttgtccttaaatatatgtttcaaataaaatatctacaattttaaggtgcttaagtactggtgaacatgtcaaaatgtgcctaatgtatttttaagttctgctgtgaacttaaaaactttgggatttgtgtaatcccaaattagagaattttaaactttagttggtgtccaccatattgtcccccttttcatccatctgaccaaacttttaaccttcctgtttatggctggggaaaaaaaaagctactttaattaaacctaagcagatagtgttgtttttaaattgtatttcgatgtcactaaaatggggaaacaggttgtaatagcagaatccttatattttttgcacatatcagcctccataaaaggatggaaattgctttgtttttcaatgttttaatttttttaatgaggagaaaaagagcaattgagagtgccataaattaaagatagcgtttctgatgtaaaatcaatgatagttatggattattgtaaatgtttgaagatgctcttggaacactgaaaaatcttagaaaattttgttaaataataattaaaattgtcttaaattagtgtgacatctatgttaaaggcaatataattagatagcgtgcttcttcaagtgcttgggttaggagaagtatttcaccatcttcattcatcaagcatttaacaattttatatgatgtgccagatatcatgttataccttggtgataatacatgcctaagacaaatttcctgtctatgaagtttggaatctagttgaaggagacaggcgtgatgaaagaaataaagcactgtagaagtaggataaaaatccgcatttaggggactgctggcagctcaaagcagactggagatatgggagaaagagaagctgatgaagggttgaatttatatttgagggaaggaaggaggcgaagtcagatcttttcatacaagaggtattgagccaaatattacaaagcaagtaatcaggtgatcaggatagttgaaactgttcagataaagggaacattatgaggatgcagaaattatctagctgacctttggggaaattaaacgtagaataatgtagctggaatgtagactgcaaatagggaaacagaagaggctgtcagcatcaggttagtaaaaccttctatgacagaccaaagacatgacaggttattctgtacatagtggggagctgtagattataatttttttttagtcatgggaagattatcaaatttcctattgcagacaaagggtctcttgttcattgaatgaatattacataatttattcaaacttgcttggtgttaggcaactaaatgttttaaggcatttttttgtagcacagctcttttttctcttttttttttttttggaaacagggactcactatttttgtatttttgaagggaaggggtttcatcatgttggtcaggctggacttgaactcctgacctcaagtgatctgcccacttcggcctcccaaagtgctgggattacagacattagccaccacgcccagaaagcacagatcttttttcaaaagaaatttgtgatgttttaataagaaagaaattaaaaaaaaaacagatacaatggaaagatatcgatcctggaacttttaaatcttggtttagagaaaacagtttattatttgaacaacttcaaacactcaagttaaaaagcactaacaaggcacatctcacttgcacaaaaatgataccaattatcaattgttggtggcaacagaatggagcagcacagaaatctggagacccgttttcagttgaatgctcatagttctaaaataggctctgatttggaattccttgtcttacttttcagtttgattaacgtggaagtctcaatatcttcttatgctgtgtgtaggaaaagtatcttgatcagtatatagaagaatatcccacaatgttactgcaactaagaaaaaattaacccattggagaaaacatttttaatcagttcattaagagtctaatgaaggtgcatatacgaaaagcaagatgtactttaattaatgattgatgttttgtgattgaagcttgctttcctaaataatatttctatacttcagtacagaatgtaaggtccttgctaatgccttatttggtttcttagtttcagtcttactgcagtctgcttttattgtaggcttattacatttatcaccatcattaatttaccatggtgttttatctttttaacttgttatttagatcacattgtataatgctttatttctggtcttgtagcaaaggaatgcatacaacaagcatgtaaaactttattgaatagaacagtctttaaaggggaatcatccataagtcagataaatccatgagtagtatagatttatctactgtaaattttctgtcaggctgttaaaagtagggccgtgtaaatcttactgtcattcacattataataggcacacttaccaatataccaactttatagttttttctccccattttacgggtttagggcttattttttttgagatgtcaagtactattttaacattgtacgtgtttcttaagaaacgccatagaatgaagacaatagggaagtctatttgtgatatattctagctcacttacattttttactgtatcttacaacagtaaacatatcacactatacttgaatttaaattttttcaagtatcattgcattattttgcacataaacatattcttagatggtatcaggttgatgatgatgagcttcatggtaattatttaaaactccataatgagatttgtttccaatctaatcaagaagggtaagaatttggggaaaaaaaatctgttctatagtaattaaagttagccatatgggcacttggctctaaagacttggatgtagtgaatctacccaacccccaagactaatgacttggatggtcttactgtattctcttgtccatagcaaagactgatgaatccagccagggaattctccaccagctctgcttctctgaaaccacaaagtcaggaaatgtaatcagagtgctcagctgaaccagagcaagagctttcctaatggctaactgtgactttagaaatcacatccattagataaagtgattaaatatacatcagtcttttggcaagagagccatgaagatattgcaatagaaccttaccacatgacccacatcttttgcttgaaaaagaaacatgttttcacctttgacacatatcatccctaaattcctcagctcagttgcaggaagcaattttttcatgataagttgtatgcagttcataattttatataaaccataaagtaattgtgtggttgataaactttataaggaaaatgtttctgactttctcatttcaccaccctgatgtgtgggtttttgttttgtattattcttctttttaggcttttcatgcttcaagacttcaagatattttgttaaattcttcccttggaagcctttgtgtcgccaaatcagatttttttaaaacttagatatgaatgtcttaagtgtctacttaggaaatatgtgtgtatgtctgtgtgtgcgtctgtgcttatatatagagagcaggcaaattactcttagcactctgaaaaagctttttttgttaaaataatgttttaaaaatattataaaaaaagtcaccgtcaaaatagcattcgctttatatttgtagttgaaataattcctgtttcttactcttagttataaccatcttttgattaataatatactgcccttcacattttaatacacatgcaactaagccgctgatgtaatacatatacttaaaatgttctttttgagctttgaataaccttttgccttttccctggtgatcaccagtgggcaagatgattgacagagaatgtgtttacaaacatggaatcattgatgactaagttaaaagtgacctcataaaatatagttctaattcttatttacagacaaaattctaagagctcaattcaatgtgtctaggataatagtgggcatagttaaataaataataggaagtgattatcatttacaaaatttcattagtgaattactaaagtatacccctatgcatactaattcctcttccccaaatcaaaacttctcatattcttaaatttctgaattcctaaaatcagcagagatgaagggatggaccagcaactataattttgttgtgttttgtgtttctgaggcacatatagggatacctagtttcatgaaaccaagtggtggggacattacacacaaagagaaagctgttaaaggcagaatgcccagacaagaatgaaaatgaaattcctggaggggcatccccatagtttttctgataatctctctccttacataaaaagcttgaattactggtaaattatccatgcaggaataatagaatcatagaatttttgtagtataaggaattttattgacatcatagttgaaagcagtcattttgtaaatgtttttggtgcccagagatactttaattatggcagaggaagttatagacaagtccacgaaccaggagtagaaaagttttcaaatgagaaatattgcagaccaagcatgttaattttattttattttttattttttattttttattttttttgtgagagggagtttcactcttgttgcccaggctggagtgcaatggcgcaatcttggctcgccacaacctccgcctcccaggttcaagcaattcttctgcctcagcctcctgagtagctgggattacaggcatgccccaccacgcctggctaattttgtatttttagtagagacagggtttctccatgttggtcagactggtctcgaactcccgacttcaggtgatccacctgcctcggccttccaaagtgctgggattacaggcgtgagccaccatgcccggtctgaggtattgttatatacacggcaactctagccttataatgcattgcccttatagtctacttagggtttttaggaatattgtgacctaatttaaaagtttgtagagagattctaattttcagaattaacagtactttcattttctctgaccattgaaatactcctaaattgcaaaatgaagtggaagtacacagtagattagtaaaacatatggttcaatgcataaattgaaataaataaaatgagactatttagaaaatgataacaaatacaacagtaaaaagaactcattacataactttgtgacttttttctttttctttcattggttccttacattttgaactctttctcactttttctgtttccttctttttaaagtaaggaatagagaaagagtgtatacaactgaataagtatttattgattaccttctatgtaccccattgggctaaatatgggagtagaaagatgaataagatggtcacagcttgggggagggtgattatgtcaaatcatgatgagaggagttttttgtttgtttgtttgtttgtttgtttgttttgacggagttttgctcttgttgcccatcctgaagtgcaatggcgtgatctcggctcaccgcaatctccgctcctgggttcaagcgattctcctgcctcagccttccgaggagccgggattataagcacgcgccaccacgcccggctaattttgtattttttttagtagagatggagtttctccatgttggtcaggctggtcttgaacttccgacctcaagtgatctgcccacctctgcctcccaaagtgttgggattacagacgtgagccactgcacccggccactactttggaggtttaagaaaagtagttgtaggtttaaaactcttggactggctcctgagggaagaattaaaatgccctattggagcatagccacctatctaggatcttgagtcctagataggtgggtgggaatgagtatcaggaaattgggctgggaccacttaggacaggcccttgtgggttaatcccataagctattgagaagccactgatgattttttaacagaagagagatgtgatcaatttttaattaccactctgacagtactatatattctgtggataagacaaaatgagagtggaaacctagagacttggagaccattgtgatagtacagataaaagataaagagaaaaagcaaagggaaagggtttagggttgatttagaaagtataatcaatagcccttgttgattagatgttactctattctgagttcccagggagtaaatggtactttttattactagcactggctactgactggcaatcatttaaatgagcgggttaaaataagagtatatgaaaaattagagtttgtggaacttgaggggcatatctaggctggaaaatagctacttgtcattttttttttttaatgttggaagactttctattcttagtttgtaggaaaaatgtacatgataatcaacaaaccgttacacatgtgctaaggtggtatattaactaattttcattggctcatgagttacatgctacctggcatcctcttgcctcttcctctctggagccacagattgttagcagagaagctggaagaacctaccatcttgccataggaaaaaggtttggtccttctggaacatgcctgtgaaaagttgccaatttcctatgtaggtcctggacttatctggaattcaaatatgactagacaccatgtattttatctggcactccgatcctatgtgtttttttttaaatatttatcctcctttgtctcttcatgaccttattatacaagttctagatcagagtgtaacagcctctttaaattctgtggcatgaactttaaatgcctgtgaagaatggggctgggttacgattggctaccagtgaattccaggtaatttagacacttcctggatttgttttccgtgtcatcatttattgattacttcatataaagtcttaatgtgtttattactcaggaaaaatgatggaatagtagcagcaatgccacaggtgtgttgtgaacattaattagttaattacaaagcatttagttgagaggcattctaaatagcacagaactcaaggctttcctccccaaccaggggtccacttaaatagctctttactaagtcaggagaaacaaacacatcttgtacatgaggtacatcaaccactaggcatgttgatctcccagggtgattttctgcatgaaaacctatcccctgggtgtcaagagctttctaagagcaatgattcatgaaccctctggatttaggacaatgctatgaaattattttcatctgtattctgaaataattacttgatgtcctattaaagtattttatattttttgccagaagttgtaggtgtaattggaaacaacagaatactcaaaaaaataaaagatcccaaaggagaataagaagaaagagagagaggaatgggctataaagacggcaagagtgatggaccagtgcctaaagattttagacagactctcaaatttactcttcttatgttctctctaaacaccattcttattagttcagcatcactgtaataactaaaaatattttaaaaagtggacaaggcagatgtcagcaaattgatgtggagaaatgggacagacacatggatgactcactcccagtcccaattccctattttattttttcatttgaaatatccatctcttcagagttctgtctagtgtgaggttcaaacaatttaaatgcttttctcaaaactattgtgcaaatgtctgtttttctgtatttttgtgtctttctgatgttcctctcctggcttttcacctactatcacaaattacatactttattatgtacttttatatatcatatacttttcaatgagcttgattcccacctgaacccacgctttagagagaacaatgataggtttctctgcacctgctccatatttagtaagtttccaattccttttggtgtcaaacaatagcaggtatctctgcagtcccttaggtcactaatgtgcttggttttgttgtcagggtagcagctgaaccatatctttcacaaacaggagatacatattttttcccagcttgagcagagcatctcacatttattaggagaaatgcccctagaggcccatctgtgtgtctttgacggctcaagtattatgtactttaagaagtttaatacattttctactggacagtattgagttgttttaaaatattaaaatcttactttgctgagataaataaaaggtattcaggcttttccaagacaagtatgagaaatgccaagttacaacaggttcactaatgagggagaagaaaagtttcatgataatactatgatctttgctattgcatttggaatttagttagacctaaataatgagaagacttttgtgatgatctattcaatttttatggcctatggtctttttgagaaattgattaaggcaggggaaaggggatagtggtagggcatcactgactcttgttttcttgcttgtttactcttttcacgaagtggtaatacaaattacctcccacagcagcacaggttactcaaaagcccagaggagcaggagaatgagacattccttattcatatttcagtaaggtattcttctccatctttgttgtttcaaggcagatgacaaaatttagtagccattttagtgcagaatactcccaaattcagggaggaagctagattcagttgtttttcagtaatattggaaagtgtaatgtgtaatgcccatgtttaaacagttgctttcttcctaacatgataaacttctatcgttagaagatattctcttgggatgaaaataaaaagatatagcataggccccgtttattttatttggggaggaggtagtagtagcggaaaatataaccagcgataccatcttcattactaatgatgacaacttacaacatcaggagctcaggaagaaggaaagcaataaataccttcatcttcaacaggattttctggcaattatatctgtttttgtttgtatgtttgtttgttttgtcctctattaatttgaaatgcctagattgtttttctggaacttagttttatatcaatcaataaaccccttttccctacttttttttgttactttttttcaagagcatactgacctcaacgtggtgaaagttttcaaaagaggcggatataagcttaaaacctgcctctgcccactcctgatctatctcaaatgaacatctgtaactctccatgaattaaaatgaggataataacatgttctaattgttatagaaaaaattacatttgtagcacagggtagctgctttatgcatatttttttctaagttatgcacaccacaattcagtactaattttgtcatgatgtcctgaagaaatcctaaaaatagagattctgtgaaagaacattgagtaccacataatcaagatatatatgtcttgattcattgattgattcattcattcagggcattatatagcagtcatttttttgctacccttccacatggatgatagttaaagactctactgaagccactagatacccatcttatacacaggctgtaatattttaactcctggagtaattggggtatattcacaataaaatcagctcaaatctaatttatttctttcatgaggtctgaaatgtagtcaaagcttccatttagttcctcgagaaaaagcttctggcaaagataacaaaggacatgattcaaatgctttctgtcttacactgctgcttcacatcaggggcagaggattttatgtttcatggccttctcctcccacatattttgggttttctcatctaatcatacagctatgatgtcagtgatggaaatttccacctcttagtttggtatcttgattgttttttctttccctgtttgcacaaaggattgtaggtggctttccagaaaagagacatgaaaaggatcactaaaaggagcttcaaaacaaattagattatttgttgtggggagaaaaatcatagcagcaggaaatttcattgtgccttttacacaagatctaacatgctgatgaattgctagtataatgatgatttatagagctgagtttcttttgaccaagcccagtactcttgcaaggttaaacaattctaatggcggatgacttgaaggactattttctaagcgaatgtacaaattacaagtccttagtttcgtaagatgctgtttcatcaaaggcttttctttgtggtttctcatatttcatattcatgttgactcccaggtgatagttaatggtatcttttttagtagtgctattatcagcttcaaatgaaataatagataataaaaagccttattattaatgtcatattttgatatatttttaactttataaggctttttagtattattaatgtcatattttgatatacttttaaccttatacttcatttattctaagtaatgtgatgtgatcaataatttttcaattaagtacttttctttttgtctgtgctagtttagtttagttgattggaatatgatgttactgtaactaaagcaaagtttggattcctgtaaaaagacttagcatttctccatagaaaggcatatgtacttttagataattctccatgatcctaatctgttatctcacaagtaaagaattgacacttagcattttgagatttaatatgtattgagtggttcttgtgctttgcccctctactcactttacattataaagcatctacataaaatgatttgtacattatctattgtaatgcacacaataatataatgaagatggggataattgctatctccactttttcttttcttttcttttcttttctttttttgaaacacaatctcactctgtctcccaggctgagtgcagtggcacagtcacagttcactgcaacctccatccccaggggctcaagcaaacatcctgtctcagcctcttgagtagctgagatccactcccctcggcctcccaaagtgctgggattataggcatgagccatcacacctggccttccactttttcaatgaggaaaccgtggtttagagaagtaaagacatgttatcacatgcaacaagaaaaaaacagaactgcaattcaaatcaggttctttctcatagttcttaataccatcctatagtcctcaaaccaaaggttccctcttgcttgactttgagatgatgtatagaatcactcttgaaataaaataaatattttatttaatttttttctttttcccagaaaagtaatctagtattttgtatcaatcaaaaacttctattttgaaaatacaagcattcctagttctataaaatatcaacatatgtaaagtctcctaaaagctttgggtttttatatgtgaagcctttacttctgttttctttttgaaataaaacattgattagaattctaaataggttatcacaaatctataatttttttcctataaaacaagcaaagtatatgacaaaaaaatcggtgctcttttttcacctcaccaagaaaattagtgtaattatttcatatgaataagactttttacctgcactacattatttagttaattttacaggctctagaaagatgttatgcaagagaagacatttcaattaatctgatgttgaaagaatgctagttttaaaactcaatgcactctatgtgctaaaaacgtttttgcagcatgaaggtagggatggacagggacatgtttgcctgagttctccagggaagctttggtggtggatgtatgcaaagggcataatctgtggtttccaaagttgaatatgcacacctaagaacaatgctggaagagctttgtcttcattcttatctttaaaagtttcaattttattcaagatcaaggtaatgatagatttaaaaaataatgataaaataaaaaatagtttcaattttgtgtatatttttaaatgcatatgttttacactgcatgtgtagattgtttataatttagcaagcatataaattcatttattgggagatcttttattattattggtattgctattattgagctggtaagggtgatgatcaaaaataattggagactctattctaaacgtgaggtagaaaattttctctgactctaatggtttaatctttaaaaaacagtttaagccacactataattaaagccataatgtttgtaacacttaattataaggatggaaaacttggtcctatagatattatcaccttaaggaaaggcaggaaagctaactgcagtagttgaccattggcacattgaaggggtcatgactggcctgcagtgtcaaaaagtgaccaaacagggacatctccatatggcattcattgactagattggttctattactgattgaagtcatttgtgttttttgtacaaactttaaatagcccaaagattctaaacgattttaaagtaaatgcaatatattattagtattatatagtctatacatacgtgctgatgtgtttgtgcgcttttctctatttatagggcatcataatttctcaaatataaggtataatataatcaggacaagacttgggaacaacatagtatacataataatcacatagttattattttgacaaacatttatgccacacatgcagaaacacaagtctgcaaccctccctatgtattgacattattctgcaagtatgcttacaaaacaatataagagagatcagaatatcctagtattcttaaggttaaaaccgaaacctttcttgtatttcctgaatgaaatgacagattaatgttattgatgaaatgaatatggcttggcttccttgagacacaggctgttagtaaaaaagcaattaagaaaataataaagaaatgaaacagcaattcctcttcctttttcctttcttctgtactgtgtcatagcaaaagtaatataatagcaactaattataggaaatctcccagactttgtaattggatctttcattttttcccacagcaactgtgaactaagaatttattcacagagcagctgtagtttgtttccagtaactcttagcagtgtctctttgtggagtcttaaagagacccatgtacatatttaggcatattggctaaactagtgccttttaaaacatctgcaggtctattgttgccaattctttcattgtcttctatcaaattaacttttcttagacggtataaagtgggagaagccactgaactcaaagctcaaagcctgacttctggtcatagcttcaatgtttccttaaacatgacttggtaacaagcaccaaactttgtaaatctcaatgtcacctttggtaagaaaaatgaaaggaatctttgcagtttatattttagagcattgctatatgtgaaagagctgtgaaaattataaaccagtgtaactcaccatgtcattatatagatatgtctaagttattcttgaatgtgaaatttccatttgcttgacaaatgtcactctattacatacatgatagttaaaagcatcttattttccatttgttccccagcccagttttcaacttttcttctaaaaaggtaaggtcaattaagagatatttccaaaggaaatagttctttagaaaatactttagtatatcaatgcacataataatacaaagaaatgcagttataaaaataaaatatagaataaatacacagctaccatattcttggcatatatttgtacatgaagaaataaacttcaaagccaggcaggacggctcatgcctgcaatcccagcactttgggaggctgaggtgggtggatcacttgagcccaggagttcaagaccagccggggcaacatagtaagaccccatttctataaaaaatagacaaaacttagccgggtgttgtggcgcctgcctgcagtcctagctacttgagaggctgaggtgggagggtcacttgaatcccagaggtggaggctgcagtgagctgtcaatgcactactgcactacagcctgggtgacacagaaatacactatcaaaaaagaaagaagagaaaggaaagaaagaaagaaaaagaaagaaagaaagaaagaaagaaagaaagaaagaaagaaagaaagaaagaaagaaagaaagggaaagaaaagaaaggagagagggaaggaaggaaaagaaagaaagaaagaaaaaaagaaagagaaagaaagaaaacgttgtgatatgattagaggactaagtcttaacgattagaagcctgatttttaaaaaattcaaaaaccaagaatcagtagtagtagttgagaaagtaaaactgagtgaaaagtagttttgcaatcaatgtggaaacactatttggtaaaatgcacttgtacttgaccttcaagtaatagatatgtcaatgttaaaatggcatgttttgaaagaaaacccatgtcaaatagtcgatataaattatagattatatttctcagataattataaattataaaatttctgagtacattcttcccaagatgtgttatttgaggcttttgtcttcactcattttcattaaggagactggtttcccatttgttttctcttttctttgttttcaagctgtaatactgtagagtaaaccctagccaggtgcttgtcctgccttacttcatcccctctttctaacagactacccgtgtaacttcctcaccagtgaaataggagacatagttcctgaggttaaatcatttactcaggttcatacaagagtggtaaagccaacatttggacttataatttcctacaatatgctacctctctagatagtagaattaaatttcaaagagaaatgtcaggagaaattccatattctacactaaggttctcatctattttattttccaccatattattacatagaagttatttaatttaaaagtctgattttaaggtaacctttatactattaactctcctccttgaagtgctacatttacaagtaattaacaaatactgtttgagcaagcacttgttcaggtgccagggactccagtttttgttaatttaaatatagatgcttgatatcatttattggggtgaaagagaataaaacaccttctcacccaccttcctaaattcattatagttaacagagggagtctataaaaatactaggacatagggactcattacattctaacaaaattctaagaacatgcatgtctttccccaggcatttagcttcccctccctcctcctattttttcatatcttaaagtaagatctaaattaaaaatttagaaattcccaaattatgttgctgttgataaaaggccactacatgtgaaatcagccttttctgtgatacattatatatcagagagtcagctattacttgtttgtgcctttaagaaagttaagaccaacttacctgtcattttaaatttgatttccgaagagcagtgtgccagaaatttggcttaaacagaccaacaaagcgtggcttctaggtgttcctgatgggcaggcttttttcaattaacttcctggggattgttttatttaattacaaggacagtttaccagataaactactcactgattgaatttctaaactcaagtctgctgaataaagccaaatgagtcatcgataaaaattcagatgccaagacctttgcaacaggtacatactctaagccatgtatttctgcattttaaagttttaaaacatccttcctctaatgttatcttttttttctatactggcctggggagtaacagatcttagttcaaatcctggctctgctacacacagctgtgttaccttgagcaaagtatctaattccatagataacgctttagtttccttagttgtgaattgaaaaattcagtgaacccaagttgagacgcattctacaaaataactgatttgtattctgcccaattgtcaggtcacgaaagaaaagaaaacaattgaagttctgttgcagataaaaagagactaatgaggtataacaactaaatgcaataaaaaatgatgtaatttaagtaagatttgcaattcagatagtaatatcatactggtgttaattttcttgattactatggttatataattgttaacattataggaagtggggcagggggtacaagggaatatttagtactatttttgctcctttcctataattagctcacaataaaaaatttaaaaaacaaataaaagttatggagagaggagaagccaacaaatagcataagtatagaactgtttttgtacacatgggcgttagacagatagtaatagtaatatcttgtataattttaatataaagagcaccgaaagagaaaaaaaaataagccctaaatcaatgccgagggtgtcatctttctttggaacccccttaatgcagtgactcctgtaagtgggcatgtccctttcatacagagttgcagttgttacaattgataagggttcatgtgagacaagcaattttgaagcagggcaactcccacaactgctcaatgtggacctcatctccttgtatttgcatagatatgctttgctgcatggattgctgcaaaattgctgaaaagactcccatacaaggagaatgcctggcactactcctccgtttgaaagctctggtttctctcttgtatcctgggaagagtgctgccaagtagtccatagacctcttcttatttccttaacttgctgtgtacattttgaagcatttatgtgtcagtttatttaactccccctgcctaataatgataataacaataatagaggtatgtattgagttcttattggttcaagtatgattctagagtgtttatatgcattaactcatttaaatattcaaaatccttttcatactcattttaccgatgagtaaactgagatacacagttaagtaacttaactaaggtgacctagcttttcagtgttggagtctggattaaaaagaaggtagcctggcttgcacttttcagcctttagaaatatacatacgaccatatccatctgctgaattccaactcaactttccttctttcctataccagctcaaaccaatttctaaccccttgtgtttccaaggtacttttaaaatacttccattcaagctgttttgccatgttttgtactatgatcatttatgtacacgtctttcttaaaaaccattagcctcttgggactaggaatattcctgggcaatgtcaaaatactctttatatgctggtgtctccaaagttactatttccaacccagcctcccattttaagttccagagtaacatggttagctacttattggacctgtctactttgtgtctcccaggcatctcaaacacaggatgtccaaaattggatttatcatttttcttccctgttctttaagcctcatcctcctagtttcctctcataagaaatcactggagtattaacttggcaggccaagtcagatacctgaaagtaatcttggatgctcatctcacttctggaatcccgagttcaactgccatttccagcctttcattatctttcaaatgtaaccacatacctatacctcaatatgtttccatacccccaccaatcatatcagttttattcacttggtaaccgatctttctgctgtaaatttaccctctagactatgtgaaaagtgagttttacaaaatatggacttgatcattttcctgcttaatctcttcaaaatcatacatctaccttcctctggaccccctttctctccactttctttgttaaggaaatagtcccttaaaaataatgaaaataatcagtcaatattttccaatgagttagtgtcaatgcccagggtctacaactcagcacaggtatcctttattaagtgtactataaaaggagtaccaaagcttagagcttaatcactggatgacactggaatgattacaactgaaaacagttagtgattagccttggtggatatattggaagcctagaatacctctcagaagatatagaactaaaaacccagccagcctctcaggccgtttacagtgtaaacaaagcaattagagccaaaggagcaagtaagttctaaggaccctggcattgttaaatggaaaaagcctccaggtgaaattgtggtctaagcataggtttctcaacctcagcttaatcgattttgggggcattcctataggaactttagcagcctctctgtcctctacccaccaggtgtccatagcaagcacccttcttcctccatgttcccatgagggaggagagtccgatatctatacagtatatgaaactaggaaatgtatgtaatgattttgtcctgcaccctttattggctttgtcaagacagcctaaatttcctgtatcttagcttttttcaataaattacaaaaatttgacagttggagccatttttctgcgacagtaattggtgattaaatcgcttaaatgccaacattagccaaaatgtttacctctacaaatgagaatctttacaatccctatcctctttctagcaggtttggctaagggaacaccaaaagcacaggcagaaaattacaattacaattgtccctcagtatcagtgagggattggttctaggacctcatgagatactgaaatctggagatgctcaagttctttacataaaatggtgtaacatttgcacataatctattcacatcctaccgtatactttaaatcatctctagattacttataatacctaatccaatgtaattgttgttattctgcattcattaggaaataatgacaagaaaaaaaactctgtacatgctcagactgtgcttatttttcatattcaagaaaggaaaagaatggtctttaagcccaagtttcaagttgtgaacaggtaatcatcattatttatcattaactcagaatcagtacacaggctctgaaaatcagctaaatctgtgaaattctcattccagtggccatgtttctgaaaataaaccagtcaataactgcctcactccagtaactatgcttctgaaagttagcaagtgaaggccagtccaagcttttgaaagtctgctaatgataaactcccagtcccgaacatcaccctgtcagtgcctgcccctatggtgctagagaacagccaatcagtaagtgtcccactctagtgaccatgtttccaaaatttagaaggtcaacggcagtcttactccagtgtccacactaacacagctggaagtccttgagtctctaaacactctgcacatttccccaaaccttatataatgtcagctgtggctttgttccaggaacttatctctcacaaatacagttctctcttgctggcaaacagaacgtttagatttttggcatccaatatttagttcaatttactgtaagttcacaagtttgcaatcctttcattggctcaactcttgtttatgtttagttatgagtttgtacctgtgagtgactgacagtgacaaagctgtgagattatcaaattcaatcttttcaattcctgggtcaattactaatatccattttttatttgtgtagaagtaaactcaaaaatgtcaaaatgcaagtaagttttgtgataaattttatgaacaatggatgtgcattaaacaaagaaaaactccttttgaagctctttgtgcagcatacaattgtttagctaatattgaaaatggtgaaaacttggatgtaagccagcaaatactaacagctaagcaaatagatgtatgatttcctcaacttgtaccaaagaaagtaataaaatcacatcttattgaaagaaattcagatgaagaagataaaataattgcagcacaagttgtcttccactttgtatatcatacaaggttttaagctcacatgacttaatttgaattgtgctacaagtattttttaatgcaaaattgtaagtaaattttctagtgctataggacaaaatctactgccgtaataaaaattagaataactccatttactgttacagagattaccacagctcaaatgttttacttttttatggcatagccatgaatgcaagtaatcacaatttgggggaaaaattcctttactcgtataataattttctcataaaaagacttgcttacaaggctattgtaacacgccttccagatgagtcttcagaaacaacaagaaattgttgcagagaccctatgattgagttagtagtcataaaaattatacttattttgtggaggtaatacaaatataaattggtggatatttgcataaaggtgtgatatttattgaaagttaaagcaaagtataaatgggactatgaacagtgttgcctcttctgccatattctacatgacgctgctcaaacagcatctgatatcagtaaagtaattgccagtaaagaaattgtcaagaaattattctatttcagcatttattctgttcagactctactaatgaagaatttttgtaattttgttggcattcgttattttcagttctttcacattttaaaattcactggctctctttaatagatgcagttgagagaattcttagtttatttaaagcaccgaaatcatactttaattctgaagaaaaggtctcacaaattcttgctgacttttaaaataacccattgagtaaagactacttatttcttgctcatagcattccatatcttttagcaataggattatgcaatttgaaagaagagtaaacattgttaattgatgccctccattgcttacaaagagttgttgaatgtattaaagataaaatggatgaaaagtttatcccttgtatgccaaggctgttttaagaggaacaacacaacttagggacagggaaaaagtccgtattgaagtggataattatttttacatttgtcatgagtatattttgaaatgtattttatcccttgaagaatttgatcctttaatggaacaggagaaattatatgcactcaaagaagggaataaaaattcatgacaatgttctgttttgtcagtggaaaatatttttaaaagttgtagatcaaaatatgcaatctaatcctgaaaaataaaaaaaaacaagttatgtcatgaaatatggtattgtgttctttagcaaaagagtaagtcccagagttaactttaagtcaatacatgttcagaagtccagcttataaggctaacactgaacatgttcaataagctggacttataagctggacttcacgatgttctcattaatgaatgttgaatggagaaaagagaaaatttggatgtgaccactatggaagacatgttacattgtagggggaacataggctttaactataaggaattttataagtcaactctgcaaaacaaggagctgttaatgaaagccaatcatcgaggaaattttcagaaaagaaatctctaatttacatactgatcatttattttagataaacaattagtaaattttaagattaagactgttctgtaaaaacatttccatttatggtcagaatatgtatacacaatgataaataattcaaatttaactgactgtgtattctttttgctaactctggtaactccacctggaggtagggaagaattatcctgttgaggaccactggtttagaccaagataaaatattatagcattcttacaattattatttaataactttattatactatttatatttcttaaaataaatatattcttggatttgccatattttcttgaggacaaaaatatttttgaaatataataaaatataattttaaaagaaaatttaattttaaaatattttagagtattgaaagtttgttttattgtagtaagttagcatcatcaggttgcttatggaaggcttatggtcctgcaagattaaataatggcttggttttgttatatttacatctgtgatttcatttttaaaaactaagaataatagtgtagaagatataaaagcagtgtgtatatttaaagtgaattttaaggacggacttagtccaaaataaaagttttggactgtggatattgcagaaatattattaataaagataatgagcaaaatcatcatatctattttatagtataagaagtaatatgataggaacaatattgaaatggattctgcatttacagactgcattatgtttcttttaaatcactacttctgaggtcaagtgattaattttcaagtgattcagaagaaatgctttaatcacttagcaaaactgtcatagccaaaaggagcttgttttggtcataacctagttcccacaaagtgagccaaaagtaatttctcatattaagcaaagatattgattacaagcaagagaaacaaacactggctgtcccaagccaaatggagatttattggaagttgttgggtactcatgcattcattggaaggctttgggaaactagagcagctgtataggaaaatgagctgacaaaagggaaatctagaggctgtttggcagacccagctggctagactactggtcactgctgccacacaggattctactatagctgtacatagacccagcacaagggaatttcaataaaatcttcctttatttggcttcattcaccaagttcaaagtaaagggcaacagaatccatttgaataagcttaggagatgatggcctcaccacttaaaataacaggagtggaatggaaatatagtcactttagtcactttagctttccacggcaggtgtcaaggctctgaattccatcaccactacacacaatgggaaatacctgttcattctagataagaaggaagattggatattggatagaaaaaaaagtagacatataattaggtcatatcatatgacattctttgtcatttttgactttttatattaaagtagtgatggaaagttagtggaatatgaaacaaaagttacaaggatgagcaataaaataaacagaaattatattaacattgagcaatgaactataacaaagttttgtcataccagaagcaaaagtaaaaagtattatttctcaaagaagaagacactcatctcttatagcactattaaataaattcttggattgtgtaataatccagtttataaagaagagtgaatcatatgaatatgttgaggaaaaatattaggatgtcttgctcatttgccataaaatggccaaacatgttgagataacaaactcttcatacatcactacattgaggatattgataacagagtggttgggtgttgtcgatttagagtatataagattagcttctgaataaggacactgtacaggctctgatatcttacaactcatatgtgaaagaaacttgatggaggtgttcccaaatttgacagtaatactgaaaattttcatgccattaccaaaaacaagttgtaaaactcagagaaatttgctcaactatcagtaatgaacatacacacactatactcagttgtggtaaaagaaagactaaatttttctatcttctccattacaaaattgatacaaagtaaagggaagatcaaagagaatgaagccaaaaatgaagggaagtcctaaagaaatgtgttaaggagtaaattaataaaattttggaatttatggtattggttaattatttttaatacagagacaacttatttaatttttgttctcacttttaataaacattcacttttatattaatctgtcttttgtgcctaatttgcccttgtatttttgcattttttctcaacctcctcccccagttgtataagccacagatccataaaacctggatctgtttataggccacagtgggttagatcaggggtttccatcccctgggccagtgacagatactggtccatggcctgttaggaaccaggctgcacagcaggaggtgagcagcagcccagtgaacattaccacctgagttcttcctcctgttagatcagccttggcattagactctcagagaagtgcaagctttattgtgaactgcacatacgagggatctaagttgcacactccttatgagactctaactaatgcctgatcatctgaagtggaatagtttcgtcccaaaacctacctccttccctgctgccctgaaaaaattgtcttccatgaaaccagtccttggttccaagaaggttggggactgctggattgccaggtgttatcactaagagagcaaataggtaaaatgtctggtaatatacactggaatattatgcagtagttagaagtgcagattagatgtatttacaacaacatgaatgctaagtactttaaatcatagtgcttagtaaataaaaacaaacaatgagaaaatgtatgtaaattagagattcatgtgtacaatattcaattttcaagaaaacagaaagatgttcataaacacattataatggttgctaagcatgggaatgaaaaacaggtagagtggcagagaatgggatatgggggcaatggagaaaaaatattaataaaaggaggctttgcatggccaatgataacaattggccacaaactgggaatttaacctggaacttgaggttaaaaaaatctgtagaatgcaggaactttggttgatattatccacaatacaagtaagttatgatttaacctttagaaggaaaataagctttgtgcatcctttaaaatttttaattagaatagtttgaagactagacaagtacaggaatagaaaatctagagagtttatgaagctatatatttcaaattccatcgaaggacaaagccaaagatgattttttttcttgtttggaaaagttgagagtaagtaaggacaatcagacttgatgacaaagccaaaaatgaaggagacagctcctggatcatagcaaactgttaacacaagagggaggaattgtaggagatacctgtcatagtacagaccagcaaatttctactcatcttccttccctgaccaaaatctttcttcctaagtccaagttaggtgccttttctgtgtgttctcattgctctcatatagtaggtgtgttgtaattgtttacctgctggttttccccaacagactgtaagccctagaggacaaggatcaaggccacctagttagtattgtgtcccaggcacctggcaccttaaaaatatttgttgctcttacctccaaacaacaacaacaacccccccccaacaataacaaacaacaaaaatgggtaacaactagagatggtagatatgttaatttcctttactatggtaaccttttttttactatctacatgtatccaatagcatcatgttgtataccttaaatatacacaataaagtgtattttaaaatatctgttgaagagtaagtaaaatgaaatgaacctattaaaggaatatcagtataatatttcacacatgtgaccattattttcataacttgctgcgggggtaaaccttaaaatcaagactaccttcattttgttttggtaatttgaaaagtaaggaaccgataatatttaggcatttttttactttaatcttttgtagtttaataaagaaaaatttccaaactacattctgttaattgtgctagcaagttattatgatggcattttaaaaaattaatgcaaataataatgatgcagataatcaatttaattgatggctggtcacttaagatcgctttctaattttcagttattaaaaggtctttcaaaataaggctacttttgtaaaaaaataatttttatactatattgtacattaagggaattcatggatggtgttttctacacaacagagaaaaaattttatgtaaacctgagagcaattactttaccaattaaatcactcaaatgttgtagactaaaataattgaaagtcaaaataagattaaagaaaatcagttttcatatacaaataatggtaagggattcaagaaaataaaaattggacttaatgcattttaacctatatagttttgaaaaccataaaacataaaccttattgctttgtgtagtcatttttcacctttgtagagtccatttttccttacatgtaaacaggcgcctattctaatattcttcatttcttgctgtgtttccattctttttgtctaagatcttttccttctgcctaaagtacttcctttagtgtatattttagtacaatgattaattctctcaacttgagttttcagaaaaagaagtttttaaaaacattttacgttcatctttttaacttttcattaagtataacatacttaaataaaaatgcatatatcatgttctcgcttataagtgagacacatagaggggaaaaacacacactggaacctttcaaatacagtagagggtgggaggaggcagaagatcaggaaaaataaccaatgagtactaggtctaatacctgggtgatgaaataagctgtaaaacaaacccccatgacacaagtttacctatgtaacaaacctggacttgtactcctgaacttaaaataaaagttaaaaaaaaaatgcatatatcctaaaaatatagtttgatgaattcttcacaaacgaaacaaaccatgtaaccaatactgggatgaaaacacagaattccttcactctagaataatattttcactctctctaatgttccagagtgtcagggactacaaaggctacaaaaccaaatgacaggtctgctttgttccaagcaatgttacaggctaaagatacactgcttgtaggatttcatactcttaaaagttcccaggtacataaaattctactaattagttaaatgaagctgtgtattcatggacaatagttaaattgtgacacagatgagtgtacctagcaccttgttagagaaagctccttagtatcaatgagatgtgaaggacatctaagagttatcagggctagaggtctggggagagttatcctggctcatgctagtcttttagtgaaatggcctggacaaattcatagtgaagatgggcagtcaattgataagattatattatatttgactgtttatttctaataagattataaaaagattataaagttaaaagcaaattgaggtgttgtagtgaggaaagaggattgtatagattcataatggctggctcaattccagtgtttttactctacttaagtgtatagatttggttaatttttaaaatttcaggtaacaaataatatggtcatcattgaaatccctaaatataataaattacaaccattgtttttactgaatctagactaggggaagagtaagataaaacaagataagtagaatgttggcaatttaaaaaattgtgccaggctcagtggttgatgcctgtaaccccagcactttgggaggccaaggagggcagatcacttgagcccaggagttcaagacgagcctgggcaacatggtgagaccttgtctctacaaaaaatgctttaaaaaattagcccagcatggtggcacgcacctgtggtcccagctacttgggaaggtgggaggtcgcttgagtgcacgaggatgatgctccagtgagccgtgatcacagtattgcactgcaacctgggcaacagagtgagtgagaccttgtgtttataagaaaatttatacctttcaaaaatttaaactcatactttctgcccatattacagctgcctccttctgtggtataaacgcaatattaaatattgtgtttatttttatcaaaataagacagaaattctcaagacagaaaatgaaaagttttgtcaaggggtttcacagacctttcattgaattttaattgcaatgctaaacaatatttgaagataacccatagtggtcccagtcttcagcctgaagtcaagaacctttagttatctgaatgttctcaagctccaagactccctaggatgttatttaagcaaagtgcaggatttccaaacactagtgattaatatatgacatctgcttactacagcactgttgtgcagccacaaaatctttcagaaaagttcacaataactatggcttactttgataaagaatagtcagtaggatggttagtctaatatgctctcataaaaaaagaaaagtattatgaggtggtgccaggaccttgggtcctatttggctatttctccaaggatctctcaatggtaagatcatcatatatctaagcttgcctagaacagtccaaggtcattcctgctgtcttggtattttctgtgttgtgtagcatttattcttgacacaaaatcctggcttggaacataaatgctgtagacatcctgccaaggattgaatcaaatttataagtgtaaccctgacagctagggtagagctgtctatttccttcctccaaagatgttatcaggtatttagattagtaaaatgagaaatactgagatacccttataattcaaggagcacataggaatggatatagacttggtttaagtattatttttcccctgtattctccagattcaatcgtttcgcacctttgactttcttatctaaactgtagagctattcaatgactaaattgtacttcttattgtctttgaatgtttcagctttatcttgttattgacatatagaatttttattatcttgatatttcacttattcaatcggaggccaggtgtaggaaggactccaatattttcttggtgccaagacatagaacagagttttcagatccatctggaaatttttctgttttcatgggagaaggcctataagagttcatactggaaggaaacattgcctctctcatctctcctgatgacatatttctcttttatcatgggaagtcttatgttatgagtagataagttatgaaggtgatgttatcgaacataggagagtaatttaaaatattattgacaaaaggggcttttgtagttataaaccagggttaagcgtatccttgtcagccagagtggagctgtatttttgtcttgctctgatgatgttatcaggtgttcagagctcagtaaaatgagaatctcagagtcaaatacatttcttttatctctatgttacctcacagttcctaaagtaacacagaaatcaaaagtcagccttttgtaccttaacggcatcattaagatggatatgtaataaagcttcaatttaacaacttaaaagatatttagtatgcttaccatggttgagggagttaaattgtacttattctaaaagaaaatacacacagattccctcataagtgtatttttttagcctattataataagacataatgactctcaagtataattaggactcagacattgtgactccagtttagttctatgtttataagtcataagctcattcctgacccaggagagtgcatttatagaaaattatcctcccaggcatgattactttaagaaaactgatcagcatttctaatggatctcctattgatcaaagcaatgctattttgtactgtgtaaaatatgtatttttaatgtattaattgtaattcattttaattaaaagtggttcaaatttatgtctattatcacttaggtatattatagataatatagataatggcaatgcatttacctgataaattcaaattcactgagctattattacctttatttaatattagaataattctacatctgtgatttccttttgcttaaacttttgtcttggaatagatttatggaaaaatggtgcagatagtaaggacagtttcaatataccccacatccagtttcccctgttattaacagtttatattagtatggcgcatttgtcacaattaacaaaaccatgtgatacatcattattattaacaaatgcccttaccctattcagagttccttagtttttcactaatttcctttttctctttcaagatctcacccaggctaccacattacatttaaccatcataccatcatatcaccttaagcatctctaggctgtcgcaatttctcaggctttccttgtttttgatgatgttgatactttgagtgagtataggttaggtattttgtagaatgttcctgaattggtatttgtctgatatttttctcatggttagattaaggctataagttttgggaaggaagatcacatatgtaaaaggccattctcatcacatagtatcaatggtacacattgtcaatgagttatcgttgttgatgttaactatgatttaaataaactttttaggttctcatgttctgattctatggtgccttgagaatgctttaaaaattaatggtacttcagtcaagattttacctgcaggaaaaaatcactatgtgtttctagagaagtgacattttcaaagcagtatttcattttacaacagttagcatcaataaaaatgtattttttatttatctttacatttgtccactgtcttaaatatttatactgactcaatctcattcagattttggcagatcttccaaatgattaattggaccaattttaaataaataaatttatttatttatttgagatggagtcccgctctctggttcaggctggagtgcagtggcgcgatctcggctcactgcaacctctgcctgctgggttcaagtaattctcctgcctcagcctcctgagtagctgagattgcaggcgcccacaccacacctggctaattgttgtaattttatcgaaataagattaagttatttacaggtaagaggctcagtgatggaatgcaaaacagcctgaaattattatagagttgtgagcatgtagctattttcctgctccttgaaataagaaaatatagagttgtgagcgtgtagctattttcctgctccttgaaataagaaaatgtcatatcatagtccctctaatcaagattaaagaaacaaacaagtaaacactacttgctttctacaagagatgtcaaaagttatcaaaggaaacatactgtttaaaggaattatctgggagatatttttaagagaataacttattctcttaaataaatatagctttcatatataagataaacattaattattacaaaagcacaacatattacaaaattatatggacataatatgcacatactctaactgagccacaatagaattggtgccctgacactaataaatcatttgggaactgcagtttggagtatttagtacctgttatgtggccaagaaggtaatagaggccactgagaccttttccagtctaatataatgggcacaactcacattttttccttttagttattaggtaaaaattagtgttggtgtttacttcagtgattttttagaggatttacaatttttactgtgaacacttagggaaacccacttcccacctcatcctatagattttccctatgtgaagggttttcatagtaccttggggatgaaaggaagtcccccaaataattttcctgatgtctgcttccaatatttgacttcaagaataccgttttccaaatagtatgttcagagccataccaggcacacagagtctctaaaactctggagagactgtaatatttctttgcttgaaggaagggatcattcttgtattctgttcagagattacattaatgatatttaaatgtttctcagaagataaaccaagtgttggaatttatttgcttttgaccctgttcagcaatattcaatgaataaaaaagaaaaaagtcttaatgatagttcttgagccacatgactttgtctaattaaaaaatattttgcaagtcttcatataaagttcaaaacaacaaaggtgaaatgatgggaattttcttaagaaaggaaattctgcagtgacccaatcctttgagcaatcaacagtcattctagggatactcttgtattgtttaaaattacattttacaaaataaataatgtcctaaatgcctcaacatttttagaatcagaaaagttgcttaactgggatgtccaagatcatttagctagtaagtagtgaatccagtattcaaaacccaggctttctagctcctgaacttgtcctagactcactactctaaactaaatctctgtttaatattacatgctcatatgaaatgtttcatgtttaaaaggccaatacattcccataaatggaaatatcctcatttaatataattaatatattttaattatggaagcatgataaaattatccaaagcaaggaattaaaatagaaggatgagacaagttaataatcttatgagctccatgaatacgtgttcattatgtgcaaaactcttcctgttaagcactttatatacagttaaccatcacaatctaaaccactcttcggagcatgattattaactcaatttttcaaactaggaatcttaggctcagagaggttatgtcatctccacagggtcaacagctctaaaatgtggagcacaaattgtaatgggaaaggccaagatgattattgacctgtgagccactgaaaccagtgtgaattgttctgtatggaatagaagtacacttcatgatatatattgtaactgttgctgaaggattttattcattttacattggatcaaatggaaatcgagctgtatattaaagattttacaaaagctccaaattaagaagaaactatagaaactcaaataaaatgaaattttttttaaaaaagtgttttctaagtagtgtttcataaagtaatacaaatttttagttattaggctgataaaataaatctatttcttttagtatctttgtcctttctttttgaatgttgttacacattcctgaaagttggaagatcagcgttttaaaataaatgctaggaaagacctaatgtaactcttgattattttacagcatcaagagttcttccttcttcttgcttattgcttgacaacagattgactgaggatgctttagagctgacaggtttggaggatgagggatgagtgagtatgagcaaaactctgaggaggagcactgcatgcctcaaaagaacttggagagaataagagttaccaaaaaaaaaaaaaaaaaaagattttgccaggctataattggaatgaagtgatataagtgacatgaatgatgcttaaaatgttgagaattaaaaagtaaatattaaaacattgaaaaacttttttttaccctttttggtttatcatcttccttctctccttcaacttccatttttttcattcagtttttcccctcattccaactcttctttctttaattgaacataatagagactcggagttcaaaatatgtgttgtttctattgaattgatagattttttttttttttttgagacagggtctctgtctgtcatccaagctggaccgcagtggtgtgatcatggctcactgcagactcaacctccccaggctcaggtgatcctcccaccttagctactctcaagcagctgagactacaggtgcacagctccatgcctggctaatttttgtacttttcctagagacagggtgtcactgtgttgcccatgctgttcttgaactcctgccctcaagtgattcacccgccttggcctccgaaaatgttggaattacaggcacgagccactgtgcctggtctattgaatggaatttatgtttatcctttccaattttaaaatagttaactttaaagttgtgtattttacattcattgtcttcaaaccaaacaaaatccaaaaacttttctactttttgaattgaattttttctctccttttgaataataaaacctggtcattgatgtatgtgtactcatctgatatttttgatttaacaaaatcaaatggagggttcacgttagtattttatgctttttaaaagtagacatgcttatgctcttccctaaaacttttatttcagcattacttagataagccctggcatctgtatttttttaggttacacagatgatttttttgtataccctggtcaatagccacagtggagtatacctgcattctgatatatacactcttgacaaccatagagacaaatgatacttagctgcatttttaacattacctaacataagtgaaagggattttaaaacagtagtattttggaaaacagcagataataaaacattaattttgtgttgtgggttattggtattaagtatcatgtaatgcccacatctcaaagctcactatggaagaattggtgtcagataataggaagattgatattgttgaaaaccatgcattcagcaagccagccattggtagcacccaatgaagtgttcagtattcatctaagcagagaaagtagaagacacaatctttactgtaactttgagtgtttgcagtgtgtcagatggtcccttgaagaagaaatattaataaaaatgaattgcaaattgtctccaatttacctgaaagagatcaaaataatgtatctaaatatatggtgtttgaaaggtgtagagtcagtccatatttttcaagcccagtgaaggtaacagaacagtttctacttaagcagctgtttgttggtttctttggctcaagagagaggtataatatcttcttttattttacagctttttaatcataataataactattataaaattaacaaatgcacatggtaactaattcaaacaatttttgctttatccctttaaagccattatctagggaataatcacttcccgcttttttaaaaaaaagtttttctgatattttcctttttatctctaaataatatgcttatgtctcatttttatttcatcaacttatgtaatgttttctaactttctaatttgaaaatgaggaatttattttatttatgtaaacttttctctttctgccccattctcaaattccaagcagttatgttttcatttctaagtaattctatgggttggatttatacctttaaatggaatatacctgaacctctatttcttgttacttaaactttagccaggatgcactaactgccttcaatgtaagataaggggtcagctctccaacttttccctcaccactaatccccctctacctctcaatttttgtaagctattccattacttttacactgataatatttaacacatatatgtgtatatcttgtctttgtgtaaataaagttctataattgtacttacattttatatatgctttggtaattggcacatttgtgagatgattaactgatacaatttaacaatattataattatgtatgtatttttcattttaaaacaagtaacatggtttgatctagaggaggaatttaaacctctcattcaaactctgctacttgaagaacacatcaaactcaagtggatcctctctgcttcaattctaccagttgttcaagttcatgcctcattttgaattgattcctatttggacaatatggctatttacacgttctaaagaaacaaattccctttgcttttattcacactatttgtgaaacatcttgtattctatgtgttttagaagtacttttttttttttgctctaccttaatccaaagtaacttaaaaaaaaaagataaaaaggagttaaattttgaattttcttatacctagaaatatattttgtttgccatcacacttgataataggttgtctgataatagaatttgattcaaaatattttctctcatcacactgaaagcattgattgtgttctagtgtcaattatggctaaggaaattttaatggcaatctaattttcattctttttagttagttatcttatttttggaagattataaaatcttgtttctattgttaatgctctaaactttcacaagaatggaacttttaaattgatcttcttttgtacttttagcttgatgactcttggtgaattttctgccattactttgtttattatttcctatctactatttgctgctctcttgagactaatgtcgaacaacatggattattctgtatcttctaagttttattttgtacttttttaatttttaaaattctcctaaaatatatagaaaaatctaagatatagaactccatgcatttttacatatacatattttcccatgtaaccatcacatagatcaaggtatagaacgtttctagcacctgagaatgctcactggtgccccattctggtaaagtgccccttttgggtaaagtaaaaggtaactacaattatgacttctccttttcagcaagcattctactgaaattttttgtttcacaaagcatgacctttacccagaattgatgttgttgtttttggtagcctattttttttttttaataaaagatactctgtctcctcaaatttctctaggaatactaactttaacttctcaatatcccacaatgtttgcttttttttttctaaagttaaaagtttggtctgttcatcttagtctttcaattttatgtttggtagatcttcattaccaatttattcttgataatctattaatatttatggaagaaaggccaggttggtgttggccaggtttgcatctgtctttatacaggtctgtttcccagacaaatcctctcttgaaagagagggatgactgaaaggtctgtgtatatacatgtatggtgtactgacaggcaggctacattttaggatgtatggatgaggagtagataagggagtcacctttccctcgactccaccctggttctagctaaaatggacatggataccctaggagtcctaccttaattaatgcagatattatccttttggtgatagcttggagataaaccactctgctacatatttaacatagagagggaagtgggacaatgttttctgcaacattattgaataaataatccatggattaatcaacttgttttctgatctacatcacatatttgccatagaaatctgtgacttctctgctagaaagaaattctaacattctcagatgagtgttctagactgtagcttctgctttgatctcctcactagggtaatcttatgatttatgataactttttttgtcttcctctggtttttagtgatattatctaacatttcgccactgtacatctttgtttttactgcaatggaaatttgaaggccagagagtgtgataaacacatgggataagaccattttcatgaactgggagctgacattgctttgactggaaagatgtgtgaagaaaaatagatgctagatagacaaatacatgatatgatatttggacagacatagatccatagatggataagcatagataaaacatatctatatatatgtgtgtgtctgcatacatagaaaataagaaagagttcagaataaatatttccatattgattttaactataggaaatcttagatacaagaataacacattcattttttaattttagtagttgcctaagtattctctaatatgagattaatggtgagtgggtaagatagtaatgagaaaacaaaagtactgcctttatatgcaacattgggatttcattctaaagaagatacaatcatagtaatgttaataaaagtggaaatgtagcaatatatttttcaaaattgtaaattaaacatgacaagaataaatattgattgatttcattgactatataaaattaggtcaaataattttaaatgatttttttcaaagtatattttctttcttctggatagaaaaacatgacattttcgttgtacaaatttgaaaagtaaagtataaagacataaaaataatccataatctcttaactagggctaaactttgttaaatgcattgtgtatttaaattaaatatcattttaaaaattattattaatttacatctatctgtgtgtataacctggattccacttattatgcattatatttttataattcatttaattcattaaatagtctttgaacgctctctttcaaagctgctcattatttcattatacattcattacttcatttagtgtaacccttactgttaggattttggattgattataatttttcaatattataaaaatattgtagtaaatatatttatacatgttagaggacacctgagattactgtctttgaataaattcctagaaggaaaattatttggcaatataaacgaattcacgtgtttaaggcttttgatagatattacaaaattaccctcaaaaagtttgtacactttatttatttatttgagacggagtctcgctctattgcccaggctggagtgcagtggcacgatcttggctcactgcaagctccgcctcctgggttcacgccattctctgcctcagcctcccgagcagctgggactataggcgcctgccaacatgcctggctaatttttttgtacttttagtagagacagggtttcacagtgttcgccaggttggtctcgatctcctgacctcatgatctgcctgcctgggcctcccaaagttctgggattataggcgtgagccaccgcacccagacagtacacattatttattactttcatccagacaggcaacactgatttcccctataacctctctaatatcactattacttttgttaaaatctttgctaatgattaataggccaaatttggttccccatgtttattttaatatttgtttctttgattactagtgaggtttgacatggttacaagtgtttattaaccatttgtatttttagataattatgttttttactaaattttatgagatatattaatatctttattcattaaaggaaaagcacttcatctgtcatttgtattgtactttttttattttgtggatgccttccacttttaaaaaccttcattgttatgagattaaatctagcattctttatctttttcgattttgcctttggtgtaatgctttacaagtcctctctactctcacattaaataagtattcattttcacttttattagaatgtttgagctttatttttccatttaaatatttactccaccagaaatctcaaatcttaaactaaatgcctgactaatgaaaactcctgtggcctgtttatccagaagactaagggaagaggaaagaagttgtagtcacacataggtcctgccccatcattgcatcttctttgtgtgtgttggtgaagtgtgaggctccatttttacttatgttgccctctgtaaccctgtcagcctatcatcttgccaccccactggcctggtacaataacttccaagcaaactcagatgccaactaaagctgctcttcttcaaagctataaaattagtaaaatgaaaggaagtttcacctctccaaactagaggatgatgatgaaatctgatcaaggtctcttcaacttccatttcacagatcatgatgttaagcaggtgcttagtgtcttcctttaatttagcttgatcagggaaatattgcccatgcatggtaccactagcattgaccaccctttgcctctgcttttttcatatactttagtcattctggagctgtgttgagcatgtgcatgggggttgggggagacagagacagaggagaataggaatattggaagaatcaaactggtaatggacatctgagttcacaacatctttgtacctagatttctgtcaaataattcttgaaagagatggtaccctccagttgaatgtagaatctacaaaaacaccagttattcaagccaacttttcttcaagagccacagtatgtctacactgaaagtctagtgaggcaagttatcccgtcttctcacctttatgatttccaaaagtgttgaggaatctccaaagcacaagtggcaactgctttgatttgattcattgatttgtttcctttttactaaatctcttcctattctgaggacaattttcacatattttaggattcaaaattcttaatgcatattcatagtagttttattaagatataatttacacaccataaaaaatcaccattttaaagtgtatcactcagtggtttttagtatgttcacaaaggtatgcaacaatcatcattatgtagttttagaatatttttatcaccccaaaagaagccccatactctttaaccattaaccacataaccatcaataatcacttcctattacacccagcctctgacaaaaaatactctacattttgtttctggggatttgcctattctggacatttcataagatggaatcatatcgtatgtggccttttggctctgtgttctttcacggggttttcatcacatccatgttgtaacatgtacctatacttcatttgtttttattgctaaatactaattcagtgtttgaatatcccacattcctttatccatttattcattggtgagtaatgaggttgtgtttactttttggctagtatgaataatgctgctgaacattcatgtaaacgttcttgtgtggacatatgttttaaattcccttgagtctgtaccaagtagtggaattgccgagtcataacttactctttacctttcagaatcatcctacttttgaatgtgtatatgaaatatcccttatttttcactacattctttaaaaacctttatcctaactttggtttccatcaaaatacaggcatacttcattttatggggctttactttattgcacttcaagatactgcattctttacaagttgaaggtttgtggcaaccctgcattaagcaagtctgtcagcgtaattttttcaacagcatgtgctcacttcatgcatctgtgtcacactttggcaattctcacaatatttcaactttgtaattgccattatttaattattactgtatgtgttatggtgatctatgatcagtgatctttgttgttactgtggtaattgttttggggtgctatgaaccacatccacataagacagcaaacaatcattaaatgtgacgtgttctgtttcagcatccctatctctctccctttcctcaggcttccctgttccctgacacacaacgatgttaaaattaggccaattagtaacccattcccacccctaatgttcaagtaaaggaagaattgcgcatttctcactttaaatcagaagctagaaatgattaagcttagtgaggaaggcatgttgaaagccaagataggccaaaatctaggcctcttgcactaagtacttagccaagttgtgaatgcaaaggaaacattcttgaaggaaatcaaatgtgctactccagtgaacacatgaatgataagaaaacaaaacagccttattgcaaatatagagaaagttttagtgatctagatagaagatcaaccagccacaacatttccttaagccaaagcctaatccacagcaaggccataactccaattgtatgaaggctgagaggtgaagaagctggaaaaaaaaggtttgaagctggcagacggtaccccatgagattgaaggaaagaagtcactgccataacataaaaatgcaaggtgaaacagcaagtgccaatggagaagatgcagcaagttattcagaagatctagctaagatcattgataagagtggttacattaaacaacagatttgcaatgaaggtctaacagccttctactagaagaatatattatagctagaaaggagaagtcaatgtctggcttcaaagcttcaacgaacaggctgactctcttgttaggggataatgcagctggtgactttaaattgaagcaaatgctaatttatcgttcagaaaatcttagaattatattatttaattattcagaatattaataattatttactattcagaaaattacataataattatattatttactattcagaaaattacataataattatattatttactattcagaaaattaaataattatattctttactattcagaaaattaaataataactatattatttaattattcagaaaattaaataataattatattatttaatcattcagaaaatctcttaagaattatactaaatctactctgcctgtgctctataaatagaacaacaaagcctggatgacagcacgtctgtttacagcatggttcactaaatattttaggcccagtgttgatacttatagctcaggaaaaaaaaaaaagatttctttcaaaatatcactgcctattgacaatgtgcctggtcactcaagagctctaacggagaggtacaagggcattaatgttattttcatgcctgctaacgctatccattctgtagcctatgggccaaagagtaatttcaacttttaagtcttattttttaataaatacattttataagactatagctgccatagatagtgattcctctgatgggtctgggaaaagtaaattgaaaatcttctggaaaggattcaccattctagatgttattagaacattaatgatttgtgggaggagggcaatatacaaacattaataggaaattggaatgagttgattccaactctcatggatgactatgagaggtttaagacttcagtgatggaaagaactgcagatgtggtggaaatagcaagagaattagaattaagagatggagcctaaaattgtgactgaattgctgccatctcgcggtaacttgaatggatgaggagttgcttctgattgataagcaaagaaagtggtttcgtgagatggaatcttctcctggtcaagatgttatgaacattgttgaagtgacagcagaggatttagaatattacataagtttagttggtaaaacagcatcaggctggagagtggtgctaccaaaggcattatcataaagacttttaaaagaggaaagttgagttgaattgcaccaaaggtaaatatagacgaaaagaaggggaatttaggaaaatttactcagaaaattgtcattttttactttaaagctatgaagcgtaaacttcaaatttctgagtataaagatggttagaaggcacgaaagataagtcccgcccattgcctgacacatagtaatcccttaacaagctgataattctagaacatgttaccttttgtagttgaaactaaaaatctgtttatgttgttattattagtttttaatgggcctttcttggcaggcaaatagttaagtctttatttctttgtttccatccaggcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaaggtgagtttattttgacttcagtggtcagtttctgttggcttccttctgtataaaaattattttaaattgagattagtgaaatttagtgaataaccatatcatgaccagaatgttaaattaaatatatatatatatatatatatatatatatatatatatatatatataggatattcagaatctgtactttttcaaatttttcattgaaattggctctggcattggcatactacttttaatttttttttttaattatactttaagttttagggtacatgtgcacattgtgcaggttagttacatatgtatacatgtgccatgctggtgcgctgcacccactaactggtcatctagcattaggtatatctcccaatgctatccctcccccctccccccaccccaccacagtccctagagtgtgatattccccttcctgtgtccatgtgatttcattgttcaattcccacctatgagtgagaatatgcggtgtttggttttttattcttgtgatagtttactgagaatgatgatttccaattgcatccatgtccctacaaaggacgtgaactcatcattttttatggctgcatagtattccatggtgtatatgagccacattttcttaatccagtctatcattgttggacatttgggttggttccaagtgtttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttaccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccttttgtcagatgagtaggttgcgaaaattgtctcccattttgtaggttgcatgttcactctgatggtagtttattttgctgtgcagaagctctttagtttaattagatcccatttgtcaattttgtcttttgttgccattgcttttggtgttttagacatgaagtccttgcccatgcctatgtcctgaatggtaatgcctgggttttcttctagggtttttatggttttaggtctaatgtttaagtctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcgttatttctgagggctctgttctgttccattgatctatatctctgttttggtaccagtaccatgctgtttgggttactgtagccttgtagtgtagtttgaagtcaggtagcgtgatgcctccagctttgttcttttggcttaggattgacttggcgatgcgggctcttttttggttccatatgaactttaaagtagttttttccagttctgtgaagaaagtcattggtagcttgatggggatggcattgaatctgtaaattaccttgggcagtatggccattttcacgatattgattcttcctacacatgagcatggaatgttcttccatttgtttgtatcctcttttatttccttgagcagtggtttgtagttctcctcgaagaggtccttcacatcccttgtaagttggattcctaggtattttattctctttgaagcaattgtgaaatttagtataatgtttagtataacatagtatacattgtttagtataattgtttagcataacatttttggacatgacacagtgatctgccaaattttataatcatacctattttttcctgctaataattaactctcatgtgtatgcagacccaaaaatcacttaaaagtttttaatgagaatgaaaattgctaatttcaattttaaaataccaacaattctttttattaaaatttcaagtataaggtaacttgatcttgccaatactatgtagtatgttgtgatttttcatgttagctcagatgacctccggtttataaagtctccctgataattttgacagtcatgtgaccctgttccctcttcactctcattcttccccctttatatttttctgtatgatatctgtcacatcttgccttatattagttactttcttcttttcatttttctaggaagttccttgaatacaaaactcatgccttatttttgttcaaactccttttcattacctgttatgatatagtttctgactatacatgtattagtcttttttttttttttttttttgagacagagtctccctctgttgcccaggctggagtgccgtggcgcgattttggctcactgcaagctccgcctcccgggttcacgccattctcccacctcagcctccagggtagctgggactacaggtacccgccaccacacctggctaattttgtttttgtatttttagtagagacggggattcaccgtgttagccaggatggtctcgatctcctgacgttgtgttctgcccaccttggcctcccaaagtgctgggaacacaggcgtgagccaccacgcccggccgtattagtccatttttacactgctataaagaactacctgagactgggtaatttataaagaaaagagatttaatttactcactgttctgaatggcaggggaggcctcagaaaacttacaatcatggtcgaaggcaaaggggaagcaaggcacatcttaacatggtgcaggagagggagaaagaggagggaaatgccgcacttttaaacccatcagatctcatgagaactcactcactcactatcatgagaacagcactggggaaaccgctcccatgatccaatcacttaccaccaggtccctcccctgagacgtggggattacaattcaaaatgagatttgggcggggacacagagccaaaccatgtcaatacaattgcagaaagaatggatgaataattttttaaaaatacagtctactgagatttaagacaaaaaggattgtacttgaggactaggtattaattttaaaataattttccatgtaaaagtgaattttacattaaattgtatttagatagaactgatacagtgaaagggagcaggaaaataaaaggacacctgaaaacaatagactctgatttgttttcttgagggaacgctgccgcatacaaataaaaagcctgactcacagacttacctcctgaatacggtgagaaatgcttattgccagaaacccactgataaccctatataaaatttagaaagtcagtgtctttcagctaacacaagtcatcttcctgccaaccggagaaaaataaggctgggatttgaactttgtctttctgatttctaagccaatgctttaggttgctttaatattttgttgttactgctggttgtttttatttcttaactgaatactaaagctatggaaaaggacacttatggaatggctacaataacatttcaagaatgtttgcttctattcatatcgttttttaaattaccgtggttagtaagtgaggaatcctcttaatttaagtcccttttaaaagctaatattagtattataactaaaataaagaaattgaactcagtgattggaaggattcttccaactctgacgttccttcaacttaggaaaatattttttgaaataactcatattttggaacatgtgctgctaaccataacaattgccagcaagtattaaaattctcaaggttttatgataaaaatattagagatagctagtttctatttggctttcttaaaatgcagtgtaatggaagggaaagaagttgtactttaaaataacttaaccacagttattgttactggtgaaagaaaatgaaaaatatgaaatacagtattttgaaagctctaagcaatacatgctaacaaatagctcaatttttaaagttactatgaagaagtggacttggagttcattggccaaggtgacattgatagatgcgttgatgacattggaaccacattgctggagtctgatggcagtgtttcttcaatataacactgccatgtagaaaggtaaactgctgatattgatgtgaaaaattgatattttggattctcaatttcatcctttctttttcctcctgcagactttcatagtattgaacaaagggaaaacaatcttccgtttcaatgccacacctgctttatatatgctttctcctttcagtcctctaagaagaatatctattaagattttagtacactcatatccttttaaaaatgattacatccagtggcactttatggtgtaatttttgctattttattcaaatatagatgttataccttttgcaccttgaaagactctggttttagtttattaatttcagtattattaatataatttgtcatgggtctcagagaagactgggagagtggcaatattaagattttaggatatgttacttttatttattactctcttgttcaaagagacaaaatagtctacaagctcatttagaatttttttcttaggaaaagttgtaagcatttcaacaagtgtcatcctcaaatatttcaaattcccactgtcgtctcttttgttccttgattctaagctaccttattcagcatgctcatcatgtgcactattctgacaaactgcatatttatgaccatgaataacccaccggactggaccaaaaatgtcgagtaagtgggtataagtacattttaatatagttttggtattatcatttcatcctttccttttcctgccaggaagttactgcatttatgaagatggggaatctttaccttcccatgttatatgcttgcttttcttttgttctttacctcctctatgatattaacctgctagattagaaaaattagatgctacagtgttttctcaaagaatgaacttgtcagatgctccatcctgttcttagacatgttacacatattttattcttgggtgtatgttttataattatatgggtgtatttttaaatgattgggtgaatttttgatagaagcaatgtaggaaatttttaggcagatctgagacctatattcttagttatttcaagtacctctgctttctgggagtgtttctgatattgacattttaatattttctggatagacctattgtagtttaatagggtgtgtccataacccaacagccatcctccaatatatgtcttccagtggttaattagagaaaataagttataaagatttacatggtggttgtattcttttcacatctagtatcccaatggaatcttgtgtttaggtacacttttactggaatatatacttttgaatcacttgtaaaaatccttgcaagaggcttctgtgtaggagaattcacttttcttcgtgacccgtggaactggctggattttgtcgtcattgtttttgcgtaagtactttcagctttttgaaacggcaaatttatgaaaatctcaggcagcacagtgttccaataacagcaaacctctggggtctgatttttccagcatggaatgtctgtatttaaaggaaaatggaagctatatgaaagctagtcattgataggcaaatactaaatttttcaaaaagactatctcccactcagaggtatgtgacatcattgagattgatcatcttcctccatgctcagcacttggatggatagtctatgcagtgccaattaggtttacactttttccaagttcttgtttaaaaatgaataaaacctataagaagcacacaaaaaactcaggcctttaaatacaagtacagtgctctttatattaccctgtattattcaattattttatatttttgtattaaaatataaaagtatatatttgtaaaagagctgtcactgcttactaagcctaagattaatgcattgtatacacattatatatacactcagtttattttcaaggaaaatattacattacagtataattttaatttattcataattgttactcttttcccaaatgtatttatcagaaaaatggatttttacaatctcatatctagatattctattttccgttaatgactttgaattatcaaagtaatccaggttcactggagccacctagacaatacagaagggtcttaagattcctaatatccgattccttcatccctgcctaacctcttttccatcaggctccctccttttgaggtcacatatgatggggcagttccatctgctacctgctgctaagaaaacattgtgcaaagaagactgcctcttctcataggtctcctttttttcctattggtacaattcaaatactacaaaattcacaattttaaagtatacaattcagtgtttttcagtatattgacaaacttgcgcaacatcaccactacctaattagagaagtttaacaaccccaaatagaaactctgtactcattagcagtcacttcaatttccttctctccctggccccttggaaaccactcatctatgttttatctctatggatttgtctatttggatttttttatgaatggaaatatcaaacagtatgcagccttttgtgtctgacacttagcatactattttcaatgttttataaaaaattaaaagtctaaattaccataatgttaagggtccaacaattgaaacatttagttgtttacgcatttaagtgtatgaatccaatttaataatatataatatctgtattttgtttgcatcaaatgagtcaaatcaatgctaattaaattaagttagttatgatagcaaaaaagacttgcagaactatacatttaaaatagaagccccaaacgtagaaaataccttgactaaaggctcaggtaagtatcatagactctatctaaattctgaataattctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactatttgggagttgttctttgttcgtttgtgtgtgtgtcgtcactgtgtgtataaactcccctattacagatatgtgacagagtttgtggacctgggcaatgtctcagcattgagaacattcagagttctccgagcattgaaaacaatttcagtcattccaggtgagagtggggttaaacaccagggctgactttgatcttttgaaagaaagacataaaaaaaacctttctttatgcaattttaattaaatttgatttcttctgttttccacaatcattatcaaaagtcaacctttgagtttaatcaattgcatgggtctttaggatgaggatgactacttggctcacatctcaacttgaaatcttccctcctgtctgagggtttgtttttccatttgcttatacaggaaggaaaatttcaatccattttaattgattttaaaatacttaggaaagagatcataaatatcagcatggggatattgcatgacattgttttttattttttctcagcaaaccatttctttattgaaaattattacaaggtgtcactatatgctgtaatttgttttggtgccatttatagagaagtggtttgtttgacaaacattagaacttacaaaaattatttttaaagtggtttgaatagccaaattgttcattttgacaacctaggtattctttgagaatatgttcctatttttaaccatttgctgtaatatataaaaacaaagtatatataaaatagcaaacccagaaggctttttttgaattaggttacttaaggtcattgatttgatataatgcatgactttctaggaaagcttgtgttttttgtttcgattcagaggctttatgtcattacaaacacttttttctcccattttcaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaagtaagaatgtccttgcatttgttattaggttgaaataatgctaaaaacattgctctcttttaataatgaaatgttgctttcattttaatcatttcaaagctattcaaatatatagaaagctgctacagtgtgaatttgggtcatgttatatatgattttcataaatcatcctggttctaagctatctagcagtactggcaaaaggaacacaggatagttccataattcctaatttctatatcataaaaaagaattattttctctagagaaataaatgtagccttgaattaataacattaaccattacatttaacaatataatagattatatattttatataattttattatatagtacatacttatatttattatatataatgtgacatatttattatgatagatttttatacttaatagattgtactcataactataacatcttaaagttctattaatcatatataatgataatattaattatcaaatataaagatagtatctgtatcttgatagtattcctaaagatttgtacaaagcaaaatcatttgctcagctttatcaacatccactttgtaaccaatgacgagtttcatagctgtttttaatggcttccttcaatataggctgatggcaagatatcaaagtttagttcagtagaattatttctgtaggtaccacatgagatcatctgtatgcactctcagaagtctgcttaattcagaagtatcaattagagtttcttacataaagcatgaattgaatgttctctaaacaattatcccctagcatggtgtctctcactggaacggttgatgaatattggatgaagatatgatcaagattgtactttctgtctgacacctggaatgtatctatctgatggtgcccacgtgaatacataaatcttaatagataatttgacccaggtgtggtatggaagtcacgaaacctttcaaatatatgtgctgttgccaaaaggaaatgagggaggaaaggtcaggattctccttagataataaaaagtaatatacatcattttcttattttaccaaatgtgtcctttctcactcactgtgataaataaaatcaaataacacctagcccacatggtaaaagactataaataaaatgacagaaaaaaatagaagccttaacaagaaaactgaaagttttgaagtaaaatgtttagcatatatatttttactaccaccatttgatgaggaatttagcatattttccccttctttttatatttaccctcttttccagtttctgattgttacaaacatgatttgaaacttatttccaatggatggagaattttatttcttaatttatatgctgtaaaattaatatatctgatgagtaacttacatttaatattgtagattattttaccacacttatttaaacttaagttttctcactgggatctgtccttttattctgagtcttgctcctatttctgagtttatactgtgaatggttttcttaacctttgttaaaagaaaaattttcaacaaattaaatttagcagcttatttcagcaatgaaatagtatttattgctgaaataagataataataataatgatttaggcagcactcagaaccaagagaagttcggagagctcaactcagcaacatgagcaggagtatttatagacagaaaaagggagtgacgcacaaaaacagcttgattgcttatagcttgacatttgccttatgtggacattgtctgataaatcagcaggctgtggttggctgaagctcagctgctgtgattggctgagacagctacttgttacaagaatatactaatagattagaatgcaatttgtttacatatgaagttagattgcaattctctatgtacacagacagcctttaatcaaatttaatttaattcatcgctttctggaattgcttcatgtatttttttttttttttgctaaaaaataatacaaaaaaagaagaaaaaaaaagaaaccccgtctctactaaaaatacaaaaaattagccgggcatggtggtgggcgcctgtaattccagctactcaggaggctgaggcaggagaatcgcttgaactcgggaggcagaggttgcggtgagccgagatcgtgccattgcactccagcctgggcaacaagagcgaaactgtctcaaaaataaataaattaataaattaataataataatagagcccttgagttatgtgaattatctttatattatatttaaacatgaatgcatgacaattagctaataatgaatcttataccacaatcctgtcttccaaatctgtacattattctttattttcttctgaaatgtagttttagtgaagaggtgtttaaatcaagtctgaattttgcttctgtttcctatgtcatagaagccatttttgactgcataattgattcaaactttcatttattggtgcgtttattacatggtttccctgagctatagcaataaatgatagcctcagcccttgctttcacagagcttatcatctagtgggaatgaaaaaaaatgtttaagggggaacagacaaataaattaaaaatatctcaagttataataaatgccatgcaaaggaagtgagtctcaggtgctgagatatcaactagatgagaagacatctctgaggtgatggcatttaagctgagatctaaaagatagtaagaagccataaaatagtttaagtgtgggtgtgagtctatgtgtggggggtgctgcttcaattaggagaaatagcatgggcaaaggtcctgaataaagggagggtatgggtttaaagaatggaaaaacagcagcgtggtttggtaagagaaaggaagaatggcaacagagaaagtagcagaaaaaataggggtcatatcatgcaggacatttcagcccatgggaaggagtttgtattttattttaaatgcagtcatttttattgctgtctgtcttgtgcacaactgattgagcaagggtagatggtagatgggaataagaaaggtaagttgaaggttgcttctctcatctaggcaagagaaaataaaggtttcatctagagtgatggcagagaaatgaagagaaaaaagatgagctcaacatacaaagtctgtagagcttgctgatggattaaagaagacaggaagcattgaggatgacttctcagtttctggctgcaataactggatgggtggtgatggttaatgaggaaatggtggacacatttgtagaggaaggtcactattagctagctaaaattaaaatgagatgcctttgagatgtccaggtggatatataatatagagaattggagatttaagtatagaaatcagagggcctgctgagtttggagataaattccagagcaatcagcaaaaagaaaggacacacacacctctacctctgaacatccctgatatttttaagtagatagagaatgggaaacctggtatttaaagcaatctggtaccaagatctacaactctgacatttagaattcaggtagaaaagaggacccagaaaagaacacagagaaagagccgccaataaagtaagaagcaaagatataaataatgaagccaagagaagaaaacatattgtagaaacagatgtgcttgtgtagaatcatgctgcaagatcaaggagtaaggatgatgaagaaagaaatatgcattaggttaagtaacagggaagtcatcagagaatttcttgagaaaatttgggtaagtggtagggttcaaggtaagaataaggtgcatacaggggtgaaaagaagaggtcagaaagaaggtaatatgtgtagacaattctcccaagaaatttggctataaagggaagcagaataatggggcaaatggctggcatttaaaaaaatatatgggtttttgtatggatgttttgctagtgataatgaatgagtagttatatatgaatcaattcaggagagagagggagaagtcaagtcctcgtgaaagtgaaagagtaaaggggagcgacagctccaccgaaacaggaggaaagatagaagagaagactgcagagttatcaaaagatgattgagttcaaacccaatggtttttatttcctcaaagtataagatgggatcattgcctgagagtgcaaatgaggaagagaaaattctacagatgatttgatgagaatgcattatatatatggtcatatcagggcatgagaaatttagtgtattttgagtgcaaatttgatgttggagattacttacttaaaatataaccattcacttggttgtgagagtttctccaccaacattcagccatttggtagccagcatggaaaagacagatgccagattatgtgtagactgtggttctgccaggttaggcactgatgataatgaatgcccatggatttaagctgtacaaagagtgacaagaacttggttgatagatcatgagaaagtgctaaggcaaatgaattggcaatatttaaaagatcaaggaattataatggtaaaggcaatctacacagagaacctgagcataatctaaaagcattttctggtgcctatagcaaagtattttccgaaatgcctttccaaattcacaatcaaataaattaacccactgtctcacctcctgctgaaaaacatacaatttgtagatttcctttggtgttgctgtctactttgatgctcatcaaacacttttttatgctgctacagatgaaagtggggttcatgtgcacagtgtgtagctaaatgtgcagtattatggagaaatatactgtggttatattgggctaaaacaggatattctcttcctcctgtttttctaatatttgacatttaatagagaaagttttgaaaaaaccgcaatattggccttcactactaacaggaattttcctatctccttcatctacagctgttttcttgtgagaactacatttgccagagtgtagagtatcatgtgcaggccctctgcccagtcctgatcccctgcactagttttctcagagttgcattatttgcccttcgttggggatatactcttcacttccataggcccaagccatacacaattgtcataagttgtctttctgagcaagggcagaattaccatttttttttctattttgctacattaatcttgaaaattaatttaaaaacttcacccagaatcttcattagatttaatatcaattctgtatttttgttatatcaattttcattttccccatacgtattttagtgataagttggcatttatttacccccacccacaacctttgccgttatgctgcattcccttttaaaaataggtttattgaggaataatttatatgccacaaaattcctttttttaaactgtataactcattttttaaactatactcagagttgtgcaacgatcgccactatctaatttaaaatattttcatctttcccaccaagaaacccagggcccgttagtagtcattccccatttcccttttctcccagcccctggcaaccactaatctactttctgtccctagggatttacccactctgtagatttaatatacatggaagcatataatatatggctttttgtatctggcttcttacacctagcataatgttttcaaaatttatccatggtatagtatgtatctatgcttcatttctttttattgctaaatgatatttcattgtatgtatatgctatattttgtttatacattcatcagttgatggacatttgggttatttccgtcttttggttataatgcataatgttgctgtaaacattcatgtacaagtttttgtggaaatacattttcaattttcagttctcagtatatacctagtagtgggattactgagtcatggttctttttttttttttttttttttttttttttttgagatggagtctcactctgtcgcctaggctggaatgcagtgtcgctatctcggctcactgtaagctccgcctcccgggttcacaccattctcctgcctcagcctgccaagtagctgggactacaggtgcccgccaccacgcccagctatttttttgtatttttagtagagacggggtttcattgtgttagccaggatggtctcgatctcctgacctcgtgatctgcccgcctcgacctcccaaagtgctggcattacaggcgtgagccactgcgcccggccgtgattcattctttatctttcagaatcatcccacttttgaatatgcacaagcaatatttcatttttctttgcattcaattttttcccatttttaaagatgttaaccttaaatcttcttgaagccaaccatcttaataatttaatgtctagttgtttagaaattattgtaaagttttctacaaacctagagtgagctacctgcattgctttacctttcatcattcttatactgtgttaaatacagtagtatagcagtgtgctaatagacagctccagagcccattcatataattcagctcctcagtggttgataaatgtgaaccagcattagtttaaaggataattctaaagtaatccatccttattaaaatattttggatgtttatgtatgcaaaattgcatcttatcctctcccatactcactctaccaggcccatccttcccgaggttcaggagtgttttcaggaaagcttttcatgcacattttcacctacatttgcacctcaaactgcaaggctttattgttttatctgtgtcttctaagtaagataaaatgatgatgtgtaattcaatcaatagttttatctcaaattgtataatagtttaactaattataataactcctgtttttgagcagctagtacagaatgtgtggatcacagtatcaagtggtttacatgcaatatcctatttatactatttaacaactttataaagtaggtattcttatacgtattttacagatgcagcagctaaggcttaatggcttaaagataattcacttacttaagaagggatagaagcaacattcaaatccaagaatatctgatttcatagtctttcttccatgattactccaaaagtctcccaataatcagattttttaatttgacctgagtaaaataggaagtcaggttcttatagtagaatagatatttaagagagatgacaaaaggttttttagtcatttaaacatttactatacaaggatagatctgcccccagtcttaggaacaagccttaacagcaaatgacagaagagttgatgagaacttttactactaaaaattagcacaaagaataccatgaaaggtgaaacatggaaaatctgcattgattacattgtcatctcctcaacacctagaattagtaggtcctaagtaagtatggactggtgaatgaaaagtaagataattttagaaaacaaattttactcacttatgttactgccttactgagtctgcctcttccggagtattgtaccacataaggatgttttagtcaatagcggaccatatatataatggtgatctcataagattataatactgtatttttttactgtaccttttctgtctttagatacacactttccattgtataacagttgcctacaatattgagtacagtagcccactctacaggtttgcagcccaggagcaataggctataccacatagcctaggtgtatggtagcctataccatctaggtttgtataagtgcaccctaggatgtttgcacaaggacgaaacgtcctaatgatgcatttctcagaatgtatcacagtcattaagtgacacatgaccgtacctttaatcatacttaaaatccaaactcatttctatgatatgcaaattccgacatgatccggcccctgcctacctctgccatcacaatcctccctctcaccacactgtagccacactggccatcttgctggcttttccacacaccaacttcatctctgccttagggctttagttctttctcttcccccagcccaaatatctcttcaccagtattttcatggctgtcttctttgtcacacttaggtcttagtttaaatatcatctccttagaaagaccgtccctgactgcagcctaccacgttgccttaatttattttctttagatcatttatcactatctgaaaatatcttgtatatttatttatttacttaaatttttatccaaccacaacctccaccctcacctaaacataaaggaggtctcataaaactaatgattttatttatcgtgtttattgtcatgtttattgcctagcctctaagagattatcaataaatatttgagggagaatatatgagaaaatagtaaataaatggatgcatattgcctgggaccaggcctgaatttgtagataaatgtctatatcaattaatttacctcctttatcacaatcacagattaaagtctgtgatgttataactgttcaaattcttcttcaacagaatatttttattacttggaaggatccaaagatgctctcctttgtggtttcagcacagattcagggtatgtaatatttgttttctttttagtctaaaggctgaaagagaaggaaaagaatgttcagtcagtttgcaaattagtctttgattctatattgctttttatatatttcatggtattatttgactcattctgtcccacagcaaatccagtctttaaaatgttcacagttaatgcatactcttgaaagcaagactttgagacagtgctcgaattaacacaagacagaagtcatataaatcttaagaaggtagaaaatgttacttctagaaaactccaccaaaagttggttggataatttcaggtcttctttctggaaaacgaagagtcacaaagtctatttttctttctactcccaagttccactcattctccaattaaatgtgactcataggtgactgaatgtcatgttttggccactctaagcaaagggattccttggacttgggtacacatattttaagaatattgtatatataagaatattgtatatattcaactgtccatcttgctgcttctctcttacaccaacttcattttgtagcatcagctgcataagctcttgcttttccccctatgcagacatctattcatcaggctctgtgtacactggcaacataggaataaactggataaggttgctgttcccagaagaatctcagaatattgtatttatttaatggcatcaggaaaaaccagtccaccaattttagaaagaaaaaagtcttaaagctgcacatttttatgaacttagacaattactatattttgactattattgactctaatctattccaagaattatacagacagaaagagctttggtaacagcctacatatcaatatttactgaaccaagaactatcacaaaacgtctgttgaaaatttccatgttttaatgatgatgatgctaatggcagctatgatttattaaacactttctatgtgcaggatgtaagctaagtaatttgtacacattatcttatttaaacttattacaagtcttattttcttgaggtagatgttattatcctattttcacagacagacttatgccttgaagaatttggtaaagtcactaagtagtcagtagccaaatcatgtattcttaatccttattcaatattgtccccctatagaagaaaccttgagtttgtaacttttcagtaaggctatttagcttgtgtcctgaagacactctcacctataatgttctttctcgtgtgtagtcagtgtccagaggggtacacctgtgtgaaaattggcagaaaccctgattatggctacacgagctttgacactttcagctgggccttcttagccttgtttaggctaatgacccaagattactgggaaaacctttaccaacaggtgagtaccaagagaaacatgcattgtatttttgaatggcatatgtacctggtgtatgttaagagcctgtattaggaggttttttatttatttgagaatggaggaaactctattatcttattaccaaaattataagtgttttactcccatcactaataatatgggtagttctcgaatcataaataattttcttatcttttctgggcatatttaatctctagatctctcgccttcctgagtatatcatcccatggggtcctagttaagtaccaggacatactgtaatgttttctcaagctgctcctgcacatggactgttttccatgcgtgcttgggatggcctgaagagaagaggctctctgatgttcacctgctcaccatgttttatttttgaactcctatttaaagttaaagatgcaattcatttctctaagtttttctctcccaaatcaattgctcccaactgtagacttccatgattttttgtattttcttccatttatatcattgatctcttgtattgcaagtggtaattcatgtggctatttcctctaacttgaatgtgaacctcttggggctgtggtctccatttacttgtatagtctcagcagccaagccaaaaggaaggagaccaaaatgattattctatagtacacataacaatgattcacttttctcagaatagctgcagatctgtttttttttcttttttggcctattttatatttactttatttccgagaatattataaatgaattcggaaattatgtaagatgcactttacagcaaaaatgggaatgcaaatattttttaaatatgcaagaagtggtcacctttactcaaaattaaagaaacacaaataaaaaaattaaaataatttttcatcagaggtaagacttatttttcatttaatatcagttgatactatcctaaattcactttaaaatgctttgtatgataaaagtatattacattatacaattattaatagaaatgttaattatcttataaatttgtttaagttacttgtagattcttaatattagacctttgtcagatgggtagattgccaaatttttctcccattctatagtttgcctgttcactctgatgttagtttcttttgctgtgcagaagctctttagtttagttatatcccatttgtcaattttggctttggttgcaattgcttttggtatttttgtcatgaagtctttgcccatgcctatttcctgaatggtgttgcctaggttttcttctagggttttcatggtttggggttttacattaagtctttaatccatcttgagttaatttttgtataaggtgtaaggaaggagcccagtttcagttttctgcatatggctagccagcttccccagcaccatttattatatagggaatcctttccacattgcttgtttttgtcaggtttgtcgaagatcagatgcttgtagaagtgtggtgttatttctgaggtctctattctattccattggcctatatgtctgtttgggtaccactaccatgctgttttggttactgtaacctcatagtatagtttgaagtcaggtaggctgatgcctccagctttgttctttttgcttagaattgtctttgctatatgtgctctttcctggtttcatatgaaatttaaagtagttttctaattctgtgaagatgtcaatggtaatttgatgggactagcattgaatctataaattactttcggcagtatggccatttacatgacattgattcttcctatccatgagtatggaatgtttttccatttgtttgtgtcctctcttgtttccttgagtagtggcttgtagttcttgaagaggtctttcatatcctttgtaagctgtattcctaggtattttattctctttatagcaattgcaaatgggagtttattcatgatttggctctctgcttgtctattgttggtgtataggaatgcctgtgatttttgcacattgattttgtatcctgataccttgctgaagttgcttatcagtttaaagagttttggggctgagatgatcgggttttctaaatatagaatcatgtcatttgcagagacaatttgacttccggtcttcctatttgaataccctttatttctttctcttgtctgattgccctggccagaaattccaacactatattgaatagcagtggtgagagagggcatccttgtcttgtgccagtttttaaagggaatgcttccagctttttcccattcagtatgatattggctatggagttttcataaatagctcttattattttgagatatgttccatcaatacctagtttattgatagtttttaacatgaatggatgttgcattttattgaagaccttctctgcatctattgagataatcatgtggtttttgtcattggttctgtttatgtgatggattacatttattgatttgcatatattgaaccagccttgcatcccatcaaaaagtgggcaaaggatatgaacagagacttctcaaaagaagacatttatgcggccaaaaaacatgaaaaaaagctcaacatcagtgatcattaagaaacgcaaatcaaaaccacaatgagataccatctcaagtcagtcagaatggtgattattaaaaagttgagaaacaatagattctggtgaggctatgaagaaatagtagcacttttacactgttggtgggagtgtaaattagttcaacaattttgaagacagtgaggcaattccttaaggacctagaaccagaaataccatttgacctagcaatcccattactgggtatataccgaaacgaatataaatcattctactacaaagacacatgcacacatatgtttattgcagtactatttacaatagcaaagagatggaatcaactcaaatgcccatcaatgttaaattgtataaagaaaatgtggtacatatacaccatggaatactatgcagccattaaaaaagaatgagatcatgtcctttacagggacatggatgaagctggaagccatcatcctcagcaaactaatacaggaagagaaaaccaaacactgcatgttctcactcataagtgggagttgaacaatttgaacacatggacacagggaggggaacaacacacaccggggcctgttggggggtgggaggcaaggggagggagaacgttaggacaactacctaatgcatgcaggtcttaaaacctagataatgggttgataggtggagcaaaccaccatagcacatgtatacctgtgtaaccaacctgcatgttcttcacatgtatcccataacttaaacatatgaaaaaaagctcatcatcactggccattagagaaatgcaattcaaaaccacaatgagataccatctcatgccagttagaatggtgataattaaaaagtcagaaaataacagatgctggagaaaatgtggagaaataggaatgcttttaaactgttggtaggagtgtaaattagttcaaccagtgtggaagacagtgacccagcaatcccattactgggtatatacccaaaagattacatatcattctatggtaaagacacatgcacacatatgtttattgtggcactattcacaatagcaaagactgggaaccaacccaaatgcccatcaatgatagactggataaagaaaatgtggcacatatacaccatggaatactatgcagccataaaaaagaataagttcatgtcctttgcagggacatggatgaagctagaaaccatcattctcagcaaactaaaacaggaacagaaaaccaaacaacgcatgttctcactcatgagtgagaggtgggcaatgagaacacatgggcaatgagaagatcatcacacactggggcctgtcggtggtggggggcaaagggaggaatagcattaggagacatacctaatgtaggtaacaggttgatgggtgcagcaaaccaccatggcacgtgtctacccatgtaacaaacctgcacgttatgccaaaaaaaagaaaaaaagaaaaaaaaatctctgtaccttcagtttaattttcctctaatcctaaaactattttgaaaaaaaattctattttaaaaagcaaagaaagcgaaaaaaaaagttaattgaaaatacctatgagatgaataaagtaattaaataagaccatctgcctagtgttaacattcaatgatattattaatatttgatgataaagaaagaaaagatagaattttaacagtaaaagggactatggatatcacctgttcctaaaatttgaaagtgagcaaaggatttaattttatgagtaattttcagactgtaggaaaaaatgcatgatttttatactactacacttaataatcaagaatcttacatgactttagtacaagcatattacattgctatattcttcgtactgaaaatgtgtttaatatttgttttccatgaagatataacttttctctttatatttttgataacatgagattataccaaactgtcagatttgctcatgcctgtcaaattgaaataatttactaaaaaaactttttattgttcaaatgacaatttccatttttccctagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggtactgttatttgatttaaaattcttcctagaggtagaaatgcaaacggttacaacagaggctctgcggtatatgcttggccttctccagctagattttctttaatgaatttttgtgtataaactgtatcctcatttctggtgtggaaaaaggaaccaattctgggctgagctagaattgatactttccccataatcatctcactgcatgaaaagtgatctaaggctgttcctcttaaaccttttacctacaatgacttagtgtgtgtgtgtgtatgtctatatatacatacacatatacatataaatgtgtgtgtatatatatatatatatatatatatataaacacatggaactatgtgtttttttaaattattatatcatgaggaaaaatcttttagaataattgattaaataatatagtcagatatataatatatatataatctcaatttatatatatatacaatatatatatgtatatatatacacacatacacacaatggatttccccagagtaccaattgtatacagtggtttcatgaaaattattttaacgttaaaattaacagatactcttctatggggtatgactaaaacagtgcatcatgttttgttaatgtcacaaggatttttaagataaaacatgagatattaagaaaataattttggtgtggctaatttaggttgtcatagattctcgaaagtttcctccttaatcctctttccagagagattcttcagtgtaaatgtttgagaaggcttgtactaagagaaacataatttcaaatgtactgcagttgccttaacatttgtctgaaggtttcacctagttaaatctcttcaaggagtctaatgtattaggggagggcaatcatctgcaatgcagataaattctgatgcacaaatattcagtgcagcattttaataatggtaaaaatcagaaaaaatttaaattttggaaaattagaaaataactaagaaaattatgaaaattgtatatcttaaagtattattttgccatagaactatgtgtttttttaaaattattttatcatgaggaaaaatcttttagaataatgatggattaaataatatagtccgatacaatctcaattttaaaattatacatacatataaaaagaatggaagaaatattagcaccaattatttctgggaggtaagatgactttttttctgtttttcatttatatctttatttcccatgtttttacaagaattttttagtgtttataaacaaaacattttgtaaagggatagtactaggttatcccaggtactacctagggaattcccagaagtttcatttaggccaatagtcattgaccttaccactttcttacaatattatgctttaataattcatttatttttcaaataactcaatctttattaaaccatagagtgcctgattctattgatgatatggagttaattgcctgataatcaaattgtctgtcttattgcatggtttatgcgagttttacattccaaaattaccttgtaaaactttaacatataatatttaatttgtctttactgtaagcaaattaataacatgtaatagtttaattctaaaatacaatagagctttatttcaacctgagacaaaaaccaaatatatactttgtaagcattctgatcattgtgtaaagaaaacgatcatttcatgtttaaaggacatgattatatgcaccatgttgttatgctaataggtgaaagatgtcctgtcctagggtttcctaggatttggaaatgactcatttaagtgttaacgtcttggcccaaccaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcaggtaccacccaaattgctaaatgtgtatcacccgaggcagaatgctagagaaaaatgtcttattttagggtaagagaactcgggagaggatagtgagtgatttcattggtatgattttaggtaaaaacctagtatcgctaggcatttatggaaagatgtacacaggtttccatttgggttcaatcatttttgaaagaccttatagtttcagaattgtcaatatattctctaataaactaattttcagaagcaaaatgttcctgagaaccattgtagaaataaagagaccattcacactatagaataacttttatatttgtatttagtctgtgttttgtaatgcttcattggttaaaaactaatcttagactagtttctcttctttcttaaacagtataggtaatagtatcactcacccatttggaactttggagaagcctttgatatcctccacccccaaccacatcaactactaatatgtagtgccatagtctgttaattctgtttatgtggaagttctctttccctttctcttttcactgaaaccttcatctctcaggcctccctgcttataattctgcacaaatccccaagatgaaccattgcttctgttttccttaggtcttccctgttttccatcacacaaccccacaaatcacttttctaaactaaaaatctagttaaaaatctacaagattctcctgatatacacagtaaaaaaagatagagtccctgccttcaaaatttcacttgaacctaggtgatgatacagaacttggacacatatatcaataaaaataaatatgacaggagcagtccaagctggttttgaggcaaagaccttaccatactttttccattgttcacaatagttgccactttgttctttacatagtaagcactaatgtctattgaactagatccttccaaaggatttacaccctggacatgagtcatataagcatgaattgaatttttcctcctctttggtattgggcaacttctttttaaatatttaatgactttataaattaactggtgctaaaagctctctttaaatacactttaactgagctcttagtatgtaaggtggattttcaatgcaaagaaccatacagcatgatttccaatttttttgtgaagcctggggattgatatataaaaagttgaatgaccagtagcaatactaagttctttttttaagttataagttctgtgcagcaaaatgaatggcattaaaagaatggagcagtaactctaggccagaatattagagagctgtatagcaacaaataatttacctggtcctgaaaggatgaattctacaaattgtttcatcccttaagtggaagaagttttcttctcactgaattgcttcgtttttaagtatgtttcttttaagtcagtacagagccacctgccctcaggccagtgggttcagtggtatttatatgaagtgtacttctatcagtaggtgcttcagcaaccacgttttttttaatttttctgcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcgtaaggacgttttacatagctcaggcatggctgggcccttgttcctgcatcagtcagtctctctgctgaagggccttctctggtcttgtgaatggctctgcattttgcaatactttttctataggaacacacctttgattcattagcctaatcctcattctatgtgttgtaggcatctaactcaaagataaaatcccatttttgtaaaaaggtacttgtctattaattttataattgaagattataaataatctctttagagaacaatttatgacggatacatatatagatagatatcagtacagaaaatgcaaggataatgctgatattagttaataatagatcccatttctatgaagaaatttggattacttgccagctactgctatctttttcaggtcacagcttaatatgtacctattccaaggaatcttatttgagttgttaataacagcaaacacatatttagtatttatgacaaccccatgagatgatacattattatctctgttttacaaatgggaaaattgaggcatggggaaatgaagcaacttgccccaatttactcagctaataaatggtagctcctaagttgaaacggaggctgtctgtttcagatcttgtgctcttaaccactcactctgctatctctccaatgtgcagtaggcttcttatcttgaaaaaatttagaatggctatgtattaggtcctccatataaatgaaacataactgttttcatttttaaaaaatatttcatctggagtctatgaatcaaaacaaaatatctgaaatgcaagcattgacacaaacaaacataaaagcaaaacaatcattttacagcagttccaaaggtctacgagtcactaagtggttagagaaaggtgtctgattaggcttgaaagtgagatctttctcattcctggagtttccaggatatctctttagcccactcactatgctatgctgcattaccaatatcagcaagggctttgactaacccaataagcttcaaacatatgctacatgcttatatatttatatttgcagacaatgtagtatttcaagtgagagtaaagttccatcaaatccatggccacacatatatttcaatttgaataaatgcatgtgcttttaggtaacatgtgacctctatgtgtgcatgatacagcttaagcccttctgcaaggtatttttcattattgaatgagcatgttaaatttctgtggaatcaaactttgcttgcattttgttttgcaattatgtgtgtaatatgtaaaatactatataatttatatcagattaggagattatttcatatttttaatgaagtttcttcatttaagagttttttcaccatagaaaaatcagtatcacaataaatcctaaagtgaaaactacaaaactagaggaattagtggatacttataagatacaatggaaatacagtaaacataaaattgtggcacaatatatggtttatatgaaaacactgcataactaataacgtcatctctatacctgaaacatgtctacatggaaaataatttgtttaatctgacaaattcttgtttgacagactatagcacagaaaacctggttttcgagacttttcaaaaagttgactttttacagagatctctcaaatgggtgtgtctgttcacatacacatagatgcataatacacccatgcacatatctatgcctgtatgtctgtgttttgatacacatacatgcatgactatacctatacaactatacaactttacaaatctagaaatatatatttaaaatatataccacataccacacacaagcagacaaacatgatagatctagagttgtatagttgtttgtgtatatatgtgtgtgtgagtgtgtgtgtgtatttctggcctgcatggaaccaacatagtgttttaaatttgaattagtttccaagttttaaaaataagacattttctcacaaaaataaatacacttgttatgcatgagttcatgtttttgcatggcaacaatttctagagctgaagagaggtcacctctttcagatgtagcttgcattctccatttcactaattgttcctttcaaactgagtcatttatcatcatatgctctgctcagttcatgaggtcttccttggcagtaagagacaaccattacaggagcttcattaatgttgttccctcaataaaaagtaattccagaaatttatcagagaatactgagattctacccctttagatacacagcactacagcactttcactgttttcatgtaggactgtcacatgacaaactatctgaataaattgaacactcagaaaggcagagaggtgatgatagtgatgatataacaaaaaagcagctagctttattttttatctcataaatattaattcctttaatcctcacaagaatatgaagcaagcactatgattatccccattttaccaatataaaactgagacagttaagtagctctcctatgatatacagccagtaagtagcagagccataatttgaacccagcaatctaggctctacttttaattactcactacagctatataagcaagattttatcttatacctacaatttattaggattctgttcttaagacattaattgattttttttttagggcacgaccaatcaaatacacaagaaaaggcgttgtagttcctatctcctttcagaggatatgctgaatgatcccaacctcagacagagagcaatgagtagagcaagcatattaacaaacactgtggaaggtatgtaataatcttcttttactgtacagattcttaaataaaattaacataaatctggtcaaccttaaataggcacatgaaattcttaggaagaattcagagaccataaaatggttttaaatgatggtaaagataaccaatggatactgatggaattgtttttatgtgcttaaaaatggataaaattatttgctattaaacacagacattgataacatggcaaaaatgactttgcaaaatgaaaaaaagaaaacccacaaagacagatgttgggtgatctgacctttcaaagataagtgatttaatagtaattgatgcagaaaacaaggttaacccagagctacgtgattctgtcactatataatcttacaaattacatattcgctcaaaaattgtctcttctaataagcaaagatagtcaaagggtgacaactttacaaactgtgctggcttctaccctctcccctgacaatatgccccaggtcccacctggtccctgggtctaacacttcaccccccacattcccattgtgggggcaaagtgtctactcatctcctaaataaatggtgagaagtaaatgggctaatggtgtgaaatgtctatttcatgagtcctccataaattatttctagttgcttggttctaggattgttttcacctgtgaactattacagcaagagttttttctggacagaatagtctcatcttattgttgtcatgggactaaaaacacaggtgaaaaatatgcatattggtggaaaacatacatttctctgttaaggaaacatagttctcctgtttaccatcacatgttaggtgcatttttctctgaaagatgcccacatatgtgcttgcagtcataaatttcacttccttaccctctcttatgcttcatctaggcaacgaacatgtcataatagacttacataagaggctatgctttcattgaaatagtactgttaaattttcaaaatctaaactataaaccttgtttcaatattagaatgcctgactgatttgtatctggttaggagtgaaacagacaaatggctgactccatgttctctgcttttttctcccagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtaagtctcttattgtgtgttatgtactcatagtttctctttttagttgtcatcattgtcatttcatattttttatgtcagatgaatctgcagcctcagaattatgcatatccagaactttccatatgaatggatgtgtagagtcaagtttctggttatgtcttttaaaataattgtgcagtactgttgaggtctacaaataacaatactatttctataaaaggttaccatcttgggagttgataatgattttttctgccagcatatttcttgggagcaacacttaacatttttggttctttctcacaccttcctaattacattgctgctttcttgtaagtacacacctcacatattttcagaaaacctatggatgtattgctttgacataatagtagtgaagtgtttgggtcctcagagtcccaaagtcctgggtttgaatgctgattctgcattatatgagtgatatgcccttggacaaatattttaactctgtagtatttaattttatcatttataaaataatacttcattataaaataattatttataatataattgtaactgtatttcatttatcatattcttgggaggattaaatgctttctgcttattagcctggcatatagtaaatacacaataaattaaagctatcatcatcatcaacatcattgtcatcaaaacttcaaagacttaatgaaacaagctttaaaaacaactattttgagaaaccaaaatggttgaactggacatagaagactcaaggataggcaagaaggtgatcaacagacttctggaagatataagatccaattagtaaaattgatgccagagtgatctctaaaatgtacagtgctggtcacactaactcagggtaaacaaaatgccagtttttgactatggatgtgaggcaggcaccagttcatttttagggccagagaatctcagcttatgactcttcataaaccatgaataactttgggtatctttgtcaatgtctatataagataattttgcttttgctgtggtcccaaacaaattgacatttgaagaccagaagttcttttctgagtctgtcttttcttctaaattgtctacaaatattcccaatgtttttccccatgtgctcgctgagttagcattcttcttcccttctatttatctttggaaaaaggcaggaatatctagtttctaattgttggtggagatccggatcttgcaaataagtaccttctcactgagacgactgcatccctgtgaactcagaaaggatttacctggtcacagctattaccacaacctcaagtccagctgctccctgccaatcttcttgatcctgcattatttgaaaattgactcctgcagttatagacctaaacatttcccttagaatcttctttggtcagattccttgagtcaaagtgtacccaaaggattcatttcggtgttgcctttttaagtgagtcctttgataccagtatcatgaattaatgatattttgcaatgcacttttgtgtcaaagctttagaagtattactttagctgccacattgtcaattaaatacttttttctcttctgctgataaatctttaaagagtgagtcaacatgttctttattactctaacagtagtcagatcagaaaaaaaaagactggctcaaaatttcagtatcaacttatgttttctttttatcttcttccagaacaactttttgacccacataaattctttgaaaatagtgactgtgtcaattaccaaatgttttactcttctgaaattttaatatgctattctaaaatgctgtctaaaaatgatgagcactgacaggacagttagagcttttcaaccttttgatgctgatatgggagccagggaagagcaatacctaatttacaggactaagttagataagaatatccatttataaagtatttagcaaactgtctggaacacagtaaatgctaagcaaacagtgattattatcattgtgttgatttcctgttttctaatattaacagaaaaacattatttttctcacttaggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactggtaaacataaactaaggttgccattatattctataataaaggggtatttctttggttttgcattatttttaaaaacttttgggaatttgaatcaaaaggcaagattatatcttgatatctagtaaaataaaatccattcattgacaaatgcacttaaagaactaaaaccacatgaatatttttacaatttttgaagacatgctcaattctaatttgaagtacacgctaatataatataaatattttctattaatatagtacaataatttatttcagagtaagaagcttgtggcttacagaatttcaatgattatatgttcataactttatgaatttggtaattaaagatcaaattgttatcccccaaaacaattgttgtctgatcttaacaatataaaaacaaataaagactttttaaagcacattcctctaatatgctagattttatctaagtgtcggcatgagaaaatgtatgaaagtattagaaagtagaattaaggataaattatcaattctaaaagaaaaatatcacaaattatgataagaggtttctatagcaatcctgaactaaaagtacatagtttcttcataatatgtgttgtaattttttgtggcaagtggaacaaaataacagagatattgaaaattgatgaaaatgaaaaataagaatattttagctggataataatgacaatattataggacttaaagtctgctttaccctttgaacaaaaatcaagattggaaacattgaaaagattttcatagtgattaacattaaactttatatttgcttttagctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtatgtaaccagatgttcatgcattttaatttctctgtggaaattattttgtgatgatgtgatctattatttttataattttataattaattatatctacaattattaattgcaaaagaatagtgataattttaatacaagaaagaacaggaaagagaacgaaattttgtattagttttcctagccaaataacccatatttatatttttcaaaatcactgcctattcattttaaggcaaaggtttctatctttttctctaattttgaaagtgatggcatatgctctcttgaagctatactagtaaataaaatataattaagttaataataacaaaaatgaagttaataatggaccaaggcaaatgaaaggactggtcccgcaccttatagccatgtgtaagactagcctctatagcaaggatcagcacctatgccccacagaccaaagccagtccaatgcctgttattgtgtggccctgggagctaagaatgatttttacatttttaagtggttaaaataatcaaaagaagaataaatgacacatgcacattatatgaaatgcaaattttagtgttcataaactttattcaaacataggaatgtcaattcatttacgtatcttctatgactgcttttacattacagtggcagaggtgaatagctgccatagaaatcgtatgcccaataaagtctaaaatatttatcatttggccctttacgaaaaagttttccagccactggcctatagcatcgcgtggacatagcaatctgcctactttttgaattagtgttttcttggcttgtactttttttttattttttttcttccttatactgattagtgaaaactttcaagcttacaagcaggagaaaattgggataaaatgctcttctatgagccactcatctcaattctcaaatctgccacgttgacttgtcacagttggtcagcttgacatcaaatctctcatcaggtatccagaaggtgggatatggtaacagccatatggtaagtgccttcacttcccactgagttgaaaaaaattactaaaatattgttgtccttgtaaccaccataaaaagaggattcagaagtcaggacagaaacttacattcatccagtcacacactaaatgatactgtgccagacatacacaaaggcatttatgcagcacaaattctagatttttactgcacaaaaaatatacatcctggattaccattctataattgttgatcaccctcaagttgtagtaataaataagcttcctagttttatatagccttacaaattccttccaatatggaatgaaatgcacattctctttgtttcttcttctctgttttgtatttataagctcctatagcaggatttgcttgtgtattttttttttttttgagatggaatctcgctttgttgcccaggctggagtgcaatgatgtgatctcggctcaccccaacctccacctcccaggttcaagcaattcttctgcctcagcctcctgagtagctgagattacaggtgcatgctaccgtgccagctaatttttgtatttttagtagagacaggttttcgtcatgttggccaggctggtctcgaactcctgacctcaggtgatccagcctccgtcgcctcccaaagtgctagaattacaggcgtgagctactgcgcccagctgtgcatttcttcttacaaaattttgacataaaatcgtgaaattgggaaaggtataacttgtgaaaacatgccacatcaaagccaataatcacaaataatttaaatgtttattatttattcaggcaaattcaaagggaaaggcattcccttggctctcaccacattttccactcaatattttttagtatcttctctgtgaaaagaaaggtatttaggtattgtttagataggaaggcattgtttaggtattatttagggtggaagaccaaaaccaattacccatggtctaatccttgtttttaagatgcttattagggcacagaaaagtggaacacaaaagttatcagacaaggaagaagtgatgagttctaccaataaggttaaataaaatgcttctgacacttaaagaaagagttctagattgagacttaagggaggtttttgaagtgggcctttgaacaatggataatataatatttgatcatggacactggtgtgagagttatgttttcctttgaaaggcaatatagatttatagtaaaaaacagaggggatatattggtgagtgtttcattcgtgtagaattagtgttaactaactcatattattattctttaattattaattcttggcaaagaaagtatacagaagaaaattcataaagttgataaccaactcttgactaatggaggaactaccaatatcatagaattaaaatttaaggaaaaaaatatattcctgatatagccttccacattagagttatatgctaaactggcttctctttttttatatttctctaatttattcttttgatcattttattgccagttaattgaaatggttaaggaccataggtttaggaaaacatttggaaaaataagttttagtcagctcgggtctatatcaggaaacttgcgaagaccattaatcaaaatgagactttgaatcaagtatacattttattaatatttcttctcttgtttaacatgataatacaaagatgatacaaatggactttattttgatttgtgatacccactaggttatagaaatattagagacttatgatttttgaaggaaagaaagttgtcacagcagctgttctcaacgaagtgagaaccgcatgagccactgcaccctgttaaaatggtttaacgcttgaacagattaaggagactaaagcagtaaaatggaccctcagatcttcaccaatattcctattaaaacaaatatacacaaacatgtatttcatagtgaaatatactttttcattgacaactattaaaccatttcagggatttttagcaattatcaaaattgttcactatgattcccagacctccgacctccagaattttctcctaaatcagacttattgagacacacaattttagcctgctgtctttacttacatctcagagaaattgttttaggtatgaccaaaatgagggatgagtaccttctcttcagttaggtcttacttcgatttttaaaacatgaggtagatgatttgggccatgaaaagacttacatcaaatgccaattcaatttccttttttgtttcctggataaaacaatgtttaaatataatttacaatttacatgtttcctgccctctgtgaacattttttttttttacaatgtggagttgacctgcacttctacttcagtgagaaaaaaaaataattaactcagaaataaaactttgcttcaagagaatagaaattgtcctgaccttttttgtaatctcttctagggcaaacataataggcaatgaagccagccaatcataatgccattattgcatgtgaatcaggttcaaggggcaggtccttttctgtgctttaaaagtcacattaagcagtattctagcacgcttcttggacagaatattttattacaggaactttgtaagtattatgtgttccatttgttagaacaagtgacatttatcttctggtaaagtgaacaaagatctttagcacaatagaaaatagtcacaattgttttgttctacctgtttctcacaggtaataaagagtaatgatagatgaatgctaggagagttttttgggttcataaaagagaacttgattaaggcactactgctacagaaatgaacttagaaatgatgtaatgataatggtgagggatcattctctctgctccccatggtaattcttcctgggtatggctgaccctctgctgctgagtctgcaggggctagtctagggatacagtgatgaggagtctaccctcgcctctgtctctctcatgtggtcttatccgtgtgtgaaaaggtgcagaaatcttcgttgctggtttgtattgtggcctatattcggaaaagtgtacttattttattttattttttatatttcctgtctccctatttctctaccccctctccccaccctgatataggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtggtaagaatgcttcatatactttgtgtttcatattaacaattagtatgaaatgaatgaaaatttcatatttctattgtcataagttcttcttaacattgcatgtagtgatggatagtttttgtgcgtgactttacacaacagcttcctgaagattcatctggtaaagttttcttactagttcttaataattgatttaatcttacttagctgtatgagaaagctcaaaggtatctttgagccttcccatgcttcatcccatgtttcctgtcagttgaaaagttacacagtctccctccacagtgcctgtttgaatccacctctccttttcatcacctttcctttgtactcactactttttgcctaaaccatttcaagcagagtctcaactgatgcctctgcttccattttgcatttactctagtttacttatttgattattttcgctcatgcagattcagtcctaatcatttcactctcatgatgtatccatgatccgcaaagtatcgctctctctctctctctcttcttttttttaaaaaacggagacaggtctcactctgttgcccagtctggagtacagtggtgctatcatagcttactgcaaccttgaactcctgggctcaagtgatcctcctgcctccacctcctgagttgctgggactacacacccatgccacaacacccagctaatttttttaaaaaagtttgtagagacaaggtttcactatgtttcccaggctggtctcaaactactggactcaggcaattcttcaaactttttccccagttgctgagattacaggagtgagccaccacgcctggccatccccaaagtctcgaattatgtactgtgcacaaagccttcacactatggccctaaccagctttgaccagctctatctcctagtgctcacccatagatttttacctgtaccaaaccaatttccttttaggtcataaacactctccacactttgcttgggatttccttctccagtcaaaatccttcaaggcatcacccttgtatttatcatctattaaattgttaatacttaaatcgcagttgggtcagggttaaatgaattaacacgttaatacatgtaaaatgtttagaaccatactcaatgttctcaaaatgttatttatttcatccctcctaatttctccccaaatggatgtagtcccttctcatttttgaaccgcaaacaattttatacttcttcctggattcagtaatcttaaattttaattttttgagaaattatggtatgcatcaaatagtactgtaaattcattgagaacaggaactctttaaaacctttttttgtgccctcctctcccacccttacctgcatatttctagtgagtcaaggtatgtattgagttttatttttattgtgaaatataacaaccgtattacaaattacttttatgagattgctttcaagtcttaaggcatcatttaaaaataatcttttgttttctctagctcatgttagaaagtatttgacagatatttaccaaatatcttctatctccttaacttactaagactccaccctccatgaatttatagtggacttggaaaacgagattatatggaataatcatgactgatatatatatatatatatatcagtaaaatgctcaggaggctgaggcatgagaatcacttgagctccagaggcggaggttgcagtaagccaagatcgcaccgctgcactccagcttggactacagagtgagactctgtctcaaaaaaaatcaatacataagattaaattaaatacataagattaaattaaattaaaacaaaataaaataaaatgctctatatttaattgagtgaataaatgattaaataaataaatcatgatatatgtttctatgtagccaaggacattttttccaagacggtaaagtaaggaatcaaatctagtcatccctcgatatctatgggcgagtagtttgaaggccccccacagagactaaaatctgcagatgctcaattcctttatataaaatggcacaatgtttaccataaaacctacacacatcctctcatatgtacactttaaattatcttcagattacttataatgtaaaagtaaatcactgacacaatgtaaatatttgttttactatattttttatttgtactatttttattgttgtatttttatatttattttttccaattattttccatctgtagttggttgactctacagatgtgggacccagggatacagaaggccagctgtattttatttgtatattttaaaatgttctacatggaagaagtaatactcccaaaattttaaaaccgtgttcatttcagcttaaagttagaaaatcagattccacgtatgccttttaaggagcaggcatctaggtttagtatcatatggaaagggaaactaactcagtcacctatttttttctaactaactctgtcacccatttaaagaagattaaaattataaactccaattgcctggcagacagttgctctcagaataaaacttggattctaggtgttaaagcacttcaggagctggggaaagtcaaccaaagacttctgaaattatttcttaacatttatgaggaattatttcttacctgttcatttttctttcatttaaagtcaatggctgacctttcatggatctccttagctgctgacaaaattcttattcttagtatgttgagttgcaacatttttaagggaaccttatagaactttccatttagcacttcattttctaactgaaaaagcagactcattaaaaggaagtgattttattcacagttataaagctagagttatacagttataaatctagagttatagagttatacagttataaaggcagagccatgtcaagagtcctaggcttgtgacttatagctcaatggaatttctacctctcttgtcctctctttgtccatttgaaacacaaaacaaacattcctattggacttaataatttgtctcccctggggtataaagccatgcagctatagaatttatatatctgtggcatgcagatgaaggtgtgttgtcataatggttagctatcttttataactagtgattttatttgtattttataactgaaatagattattttaaccattcataaaattactctgtcacttattccatgagcccttccgaaagcgtatgaaatctagtgccctataaactgagttgtctaaaaatcatttgatgttaatattctaatattcttgattttcactaatttttttctcattacataatggttatatctatatgataaaagagtgtacattcttactctattacatttccatggtatgcacaattaaatatacaggagtttgtggctaccttagaggttgtagtaacagatacacaagctagtatttttaagtcatgtagcatagtgtttgaattagcaagccattttaaaaaaagtgtttgttgtcatcgatttctgcatcattattattacttaagaactcaggttcttagtgctactgacttctaattatgaactttgaaagtttacccttcttcataaaaaattttccatgacgtatctcaaagtatgtcatattaagtatagacaaacctacctgaaaatataagaattgagaaataatgaaggttcaagatctagaggaaatttgtttgataagatattaagctgtggtcaactataaaaaccttacatctaaggtctttctttccagcctcttcagattaaaatgtttccagtttaaattctgtcatttttgttttgttttgttttcccattcagatcactaaaatagtgtacattttatttatttgtctaaaatgtctttaatcctcctatgctaacttttcctgctctaattctcataatcttcatctcccacttgagttcccagagtcttgaactgtgaattccctcttttgcaacttttatttttttcgtatctgagatgcctttgaaatagtgatggttgtgtttgtgatgagcctggatgagccaaagaggcaaattgaattacccaatagaaagtaactcctaatttatatatttatgtcattaagtcttagccactaccttgggatatagttaagaatgccactttttaagatagaatatttgcctcaaatcttagcttttgataagaccttgagcaatttacaaaaacatttttttcagtttatttatgtgtaaaatagattgtaataaagattatatgattctcataaataattagacaaatgcttattgaaaagtgctcaatgtacaattattataagtatggaattgagtgcttatatacacactgtaagtagctattggttacagattgaatttaaaagagatagcgtgatgaagatcagtgcttcagaattttagtgtgtgaaagacatacttggggactttattacaaatgcctgttctggatcatatcctttgaattgtttgcctaaatttggatgcaacttcagaatcattaacaacgtttgcagcagctactgatcaatagagactactatgaacaatcatactccaacaaattggaaaacctaatggaaattgataaattactcaacacatacaacttgccaagactgtatcatgaagaaatggaaaactcaaacagaccaataatgagtaacaagattgaatcagtaataaaatctctcctagcaaagaaaagtccaggaccacatggcttcactgatgaattctaccaaacatttaaagaagaactaatactaattcttcttaaattattccaaaaaaatcaaaaggaaaggaattcttctaaattcattctacaaggccaatattaccccaataccagaacaagacagggacacacacacacgaaaagaaagctgaaggccactatccctgatgaacacagatgcaaaatgccccaacaaaatactagcaactcaaatccaacagcctatcaaaaagattattcaccatgctcaactggaaatcgtcccagggatgcaaagatgtttcaacatttgcagaacaataaactttctatattatatcaacagaatgaaacataaaaaccatataatcatctcaatagacagagaaaaagcattttataaaatccagtatcctttatttgataaaaattatcaacaaattaagtatagaagaaacataccttaatgtaatgaaggccatatgtaacaaacccacagctaacatgatactaaccagggaagagctgaaagctttctctccaagatctggaacaagataaggatgcccactttcactacttttattcaacatagtaatgaagttctagccagagcaatcaggcaagagaaagaaataaaggacatttaaattggaaagaaggaagtcaaattctctttgtttttatatgatctgatcttagatatagagagttctaatgaccccatgaaaaaaagtagtagatttcataaatgaattcagtaatgttggaggacacaaaatcaacatgcaaaaatcaatattatttctatatgttaacaacaaataatctgaaaataagaaagcaatcccatttacaatagctacaaaaaataaaatacctagaaataaatttaaacaaggaggtgaaatatatttacaatgaaaactataaaatattggtgagagaaattgaagaggacacaaaaagggaaagatattccatgttcatggattagaataattattatttttaaaatgtccatattacccaaagcaatctacaggtttaatgcaatccctatcaaaataccagtgacattctttacagaaaaaaaaaaaaaaagtcctaacatttgtatgaaaccacaaaagaccctaaatagcccaagtaacctggaacaaaaagaacaaagctgatggcttcacactaactgacttcaaaacatactataaagctatagtaaccaaacagaatgatactgacataaaacagacacacagagcaatacataagaatagagagcccagaaataaatctacacatatacagtcaactgagttttgacaaggttccaagtacctataatagagaaaggacagcctctttagtaaatggttctgggcaaactgaatagccacatgcaaaagaatgaaattagacctttatctcttactttatacacaagtcaactcaaaatagactacttaaatgtaagactgaaaactacacaactattagagaagaaaaaaaacagggggaaagcttcatgatgttgttctaggcaaggatttttttggataaaacctaaaaagcacaggcaacaaaagcaaatatagacaaattggattatattaaactaaaaagcttctgcacagcaaggcaaacaatcaatagagtgaagagataacctacagaatgggaaaataaatttgtaaactatgcatctgataatgggttaatatctaaaacatacaaggaactcaaacaactcaacaacgacaaaaaaaacaaataattcaaaaatggacaaaagacctgaatagatatttctcaaaagaagacaaagaaatgccaacagataaatgaaaatatgctcaacatcactaatcaccagggaaatgcaaatcaaacctatcttgaggtatctcctcaccctagttaaaatggctaccatcaaaaaatcaaaagatataagtgtttaaaggatatggagaaaagggaatccttacacactgattgtgagaatgtaaattagtaccaccattatggaaagtaatatgggggttctttaaaaaattaaaaatagaattttcatatgatccagcagtcccaatactaagtaaatatccagatgaaatgaaatcagtatgttgaagagatacagtaaacatagaatactgtactcctatatgtttattgctgcactgttcacaatagccaagttatcatattaacctaaatgatcgtaaataaataaatgcataaagaaaatgtacataagaaaaattgaacgccattcagccataagaaataatgaaatcctgttatttgtggcaacatgaatgaacctggaggacattatgttaagtgaaatcagccaggcacagaaagtcaaatatctcacacatatgtggaatctaaagggttgtcatagaagtagatagtagaatagtggttatcggaggatgggaggcttggaggagcgaggtgtggggaaagattggtcaacaggtacaaagctacagtgagatagaaagaataagttctggtgttctattgaatcgttggatgactagagttaaccataatgtgttgtatatttcaaaatagctagaagtttttaaatggtctcctcacaaagaaatggtaaatgttcaaagctatggatctgctagttaccctatttgataattatataatgtatacatgtatcaaactatcacatgtaccccataaatatgtacaattattatgtgtcaataatttttaaaataaatgatgccaacttaatccctagcttacttggattcaggtttctgagatattattttctttattcaggggctatgggtatatttccccttttgcttgtttaagaacctgcattttgagcaaggggaaaaaacatcactgacctttgatatctctccctctcttctccctacccaaaaaccctctcttttatgacctagcatcctggtttctcaacagagtttatggagaattttcagtgctctcctagtataagttttcaggttgacagatttcctcaacctgatagacagttaaaaatacactccagaatcaaatcaaaatattttacagtaaaacctcttatcagaaaataaccaaagagatgagttaaaacaaacggtttagtcaaatatcttaaacagttctgaggaaacaaatggaaatagaacaatagcacttctctgaagagatagtcagtgtcagaatcaagaaagacatgctgttatctcaaaggtacccatgagaataatactcttttcactgtttctaagaatgcaggcactgaactgatggctcttctcagagtcagccttctcctgaagtgcaatgaagccctccaagcacactccaaacattaacaacacactacacaggcttttttaccactggcagtgaagtgcttcctcattagaagccttaaaggaagtatgaaatgcacccatttgtcaataaatatttattacaccttactatgctctaagcactgtgctaagaattgctgagggaaaaaagatcatgttctcacacagctgcaacaatttaatatcgggattaacttgaaagttaaaatataagggctcagggtctagatatataagattgtgagctgatccaaggatgtattagtttcttacggctgttgtaacaaattagcaaaactcagtggcttacaacaacagaaatttattcttttgccagttctggaggctagaagtctgaaatcaaggtctgagcaaggccatgatttctctaaaggctctagtaagtatcctgccttgctgctttctaactttggaggttgttggcaatccttgcagcttgcagctgcatcatcccaatctctggcccggtactcacgtagttttctccctgtgtgtctcggtcttttcttcttataaggaccccagttatattggatttggacccacacaatgacctcatcttcattgtgtctgcaaagaccatatttccaaataagatcacactcaaacatgccagggttaggacttcaacataacttttggaggattacaattcaacccacaacaaagaattttgacttagaagactagatggttattgatacaattaagaatacactgatggaggagaaaattgaggaggtaggggaaatacagagtttaatttggtggcatcataaatttgaactacttgcagtacaggcagtgaacctgaacaggaggtatatggaaagataaatcttaaggaaagaagaaaagtcagagttgtagataggttgggattttgtatgctaactttcattaatcacgggattgtgtaggggtcagttccctgggaaaccaatcctgagagagaaatctgagatttactgagaagtgttttcaggaacgaaacgtaacatctgtaaaaagtgaggcatgcaaaattattgggcagagagagaagttgaactgttaaaattgcaacagagatttcggctgatcctattggcatctctgatgctgtgacaaccctctggagtagttccaaaacaaagcaagagggtcaggcctttcttctccacaccattcattggatgcaggctctccctttacctttccaggggagaagggtataaccttgggggaagcacctcccttctgccacgataaggcccaaagagggattcagatgtgagccttcagcatccaacacttttggcagctgggggaatgagcagcttgctggaaagcaggatgtggacagtgccttagagcatctacttcatgacagaaccacagacagcagctgagaacagcggatcaaacacatttgagaggtggatgcaaaagaagaaagcacgcacacacacacggataaaatgtatacagtagcccctttacacacattatataattttcgtctttgtgacctccttaggaagtaaatataatgcatctatatttgcagatgactgcgattctaaaagattaagaaaagatttggttagtcatggacgtatctgggggtctttttaaatttaaaccccaagctgtaatcattatactacatgccatagaaaggcaagaaaatgagtagtagtataattgttttctgctatacctctgtaatggtgtaattcagggtgaaattttctgttgtaatggtattgtacatttgctgattcattgggattctgatattgtgcttctaatccaccttaatgctgactgattaggttatagtctaccttggtaataatgtgtgatttttatattttaggtgtttaaatttgtttcttcaaaactatcttattcccttctttattgaaaagtaaaactgattttacttctagaatatatttctttctcaagactacataaccctttcctttccatttattcagtattaaatgcatattttatacattatggtatttcatgtgtatctgtatatttatttttgcatatattaatgtgtctattttttcatgcaaattattgataaatatgacaaactcatctagaccaaattcaagttcttgtagcttctgcctgatacattcattcttctctaggtgaaaaccttgctgaggtaactatgaggttcttagtgctactaagacttatccagctctccctggcttgttgatgaaattggcaagtgactcagaaatatcactaaagtccagatcattgcctttaaagcatctcctttgtcatgacttattatgttattacagaaaagtattaaatcaatttggcataattttttctacacatcactttgctctctttgaacctttgtgttctctcaggacaatgtattaagtagaattgatttattattatattatctttcacattaaggctatattaggggctagggagtacacttactgccacaccaaggtacacatgttaagatcttaactatttgaataaacctattttacttaagggtacatgggtaatccctatttttttgtgtgtgtgttttgttatttttggctatttctgagtcaggactctgtttaactgcatgcaacagagacttaactacattggcataactggatagaacattctgttttcatattttaaaacatccacagatcagcagtccacgtggcctccatgtcctaggctccatctcttctcccttctgccaatcttcacatgtgttttttcttctatattaatgcctatgattagaggtgactgttccacctacagctttatatccaatacccaggtagagaaagaaatagaacgaagcagaagtaatgactatcccacttgcctgaggaagggcaaaactttcccagagatccttatccaactttggcttatgtcttattggcaagaacagtgtgacatggccacccctaacaacaaggtagcctggctgaggcaggacatttatctgggcatattgctaccctgaataaaatctggattctcttggtaagataccttggaaggtattaacaaggtcaggcatgcttctccaatattactactgctactaattattattattcctttatgaaaatgtcaaaagaattgaaggatggtaattttctattttaagagatgcagttactaggcataatttggaataatatgcatcaattgtaatgttatactttgaaacatattgtataaaattaccaaaaaacaaaagttaatttttacttattgaattagaaaatatatatgaaaataagaatattttaagttaaataataaaaaactaaatatccaaccatttttaatctgcaaaaactagaaatttcatgtggctcaacataatacaaaggcataagtaaaatataaacttcattctacctgtataatcttatttcttaattacataaatattatgttactgaacacagatattttattcatttcttttatttgtgcatagtagagaacacattaaaattttctatgactctctgcccagaattataataggcatagagtttttctctcctaaattacactcatgaaatatttttggccccctataaatattgagtcccccaaaaaccacactaaaaacttcatgtacttcaaaggtaaagggtgattgatcattgacaacaaaaagtatacactctaatagcttgcaccttaggtaaatatacaaaaaattataacacagaacaaagcaaagcacaatccgtaacaggacactaaactagtccattgaggatgcattgagtaaggggctgtatctggctgacttcacatgaaaggaggtggcacttagaccagaccttacagtatggagaaaatttcactgggcagatgtggtacagaaggaaatctcaggcagaggaacaagcattcatattgttcacctgattcactcattcattcatctatccacccattcatctattcagtgttcagtttacaaagtcattatctttggagatacttaaatatgcttattattatgaaatgtagtcattttgttgacctgataaaaagttgtttcaatatttgcagttcccaaattaaatatttaatgtccttttactatgtggtggttttaattacactgttatcaagactttctctctttagatttttaatcaaagttttagatttaccttctgcttattactacactttagaaaatataataatcttttaaaaatgcatttgactttgaaagatttagggattagttacagttatgctgtttcgtaaaattggcatttgattctatattttatgcatagattttttttaaaagcactcttctgtagaattgcacttagaccatttgtttttttcaggttgtttccaaagaatttgaaaaatctttccatcttcattggatttgtttacgtgcctaaaaacaatgaaatatttgtctgacatattcaaatcaatgtgtcttattctttatattttgataaatttggaaacttcacttttttgcaatgctgtttaaaatgtcaaaattaattaaataaaaataagtcaatcaagaaatgctaattttagaatatgctttttaaagctgcatactcttactgccacctcaccccctatactgagaatcacttatatttaaatgttgcttgcatttaaggaaaaatagaatgcaaaacattgcattagcacattatagtatttaaattcaatttttaaatagtagagtagaattatgtaactgtttaattgattgtttttaagtctctgttgaatgacatttaatcttagtactgtgattcaaatatattgcttaacgttgagtatatagcatgtactttcaaatatgtaactaatttctacttacaggtatatgactttaaacattttaaaacacagttgactaaactctttcatcatgctgcatttctaaaattcagtacctaaccttcttctcacaggggtaatatcaaactggatcagtcaaggatgcagctctgtgcttttaaccaggcagagacatatgtcaccacttttacacaggttacctaaaaaaatcatacatacgatattttttcaatgtcttgcatgctgttcagctacaaaacctttctgcctgacccactgcaagaaagtagaaacatatacagttgttcaatagataaagtgacatcacagcatgtcaccagggcaatttgattatttttttgtgattctcttgatgacttcttgatgtaaccttcatgtgcttaagtgatttcaagtgcatgatctgtagatttttattgaattgattataaaagtaaaatgcagaatgtaacagtagccattgaagctacatttaatttgaaaacctctatcaacttcccttcctgatttaatctacataaaaatatggagagatgtatatcacattaaattgtcacatttaaattaagtagatcaaaactctaaaaaattgtggaagaagtgtttctggcataaatataaaatctcagagcaggaaaagatcattgtaattctagctttgtatttaataattctggttatgtatttatggataagcaaattgagactcatgctttcttagtacacatctagaaagttggggtcaaagccaaagtaccctgcttctagtataaactttgaatacattttgaaatggttttatgcactgttagttatgggactttatttttttaaatcaactcagtaattaacatttgattttatttgctcctatataaaatgcatcagttaaaagttgataggccttgcctatgaatgaataagtgataagtgttcaaaatgtttaattttattccagaagtaatattactcattgataagaataagtttctgattatatacataatcagatcagtctctagaaactaagaggtttagatagagcatattataaatcctatctatcaataacacatagaacacttttactgaaattagatacagattaatatgtattgccttattgaatatttctaaaatgtattaaaatacatactaagatatattttaattttagcatactttgttgaatgactgaactttaatagttctaggatgggggcaggaatctctgccaataagaatcttgactcctttttataatctagttcatattttgaatttctctgtcattgttgagatgtttgtattattgttatctattgtgcaatgatgaaagcaaaactttatcctgaaattgacacaccttagagataatattgctaacagtttcaaatgaaaaattagttattttagtgttccagtttatttgaagataattttaaaggtggcctaagtaaaagatatatttttctatttcaaatttggtggggatttagaggcaatattctcatagaaaactattttattccagaatatggtgaattttcttcaactagagcctaaataaggatgcatatacacccaatattatctatataggtatagataaaacatataatttttgagaaagctatttctagaaatatatatacatgcatagacatataaacatatgcatatatatgttttgaattcataaattcttattacttttttaccaagctgttagaaaagatgaggtacatgttaatgaatggtcatcctcttaagaaaaaaactgaatattcagttaagaatgacttgaaatatggcactttagcaaaagctgcctacataaaggatatagttattttatccatgtaaaatttctatttatattttcaatattagaaatccacatgtttaaaaagctagtaattattccattcattaaaattcacttttccttgccctccttcattgtgggtagtattagtagttaacagaaatgattcagatatctaggtagcttactttgtgtttgtcattcttgtttgtttcaaaattatagataatatttacgaagcttgagtctgcgtatctacactttgcctttatgtttgctaaggttccaatccttctttacctacttgttgcatttttttaagctggcataaatagcaaaattgtttaaatgtttgcttctaaagactttaagacactctgacttgacccactgtattccagctgctttctctgcaaacagtgtagcagttctgtgacagagcacagagagagcccttgaatatcaatggccactttacactcctagctctttgcttctcttcttttcattagaaagatgcttcaagatgatactataggacctggctgagaaatctgtagccagtctagccttcttacatggccaactgttgttgcttttatatgatttctttatattcatatcttatcatttagtcacgtaagttttcatgttattggatagaaagtgccctaggtagaagattctgagaaaaagaagaggtctccgtgaaatcactggttttattctgaatttctctggtggtggctgagatttgacctcattatttcaccaacagaatactatatatcatgttgaccttgtgatggaactgtgtgtttcacgctgaataagtagctattcctcccagagcctacacaatatttctctgctagcaatagacaaagaaaaataggaaaggaaaaaaaattggttttcttgccctttttttaaaaaaagagctaaagttttagttgcccataattagaatgtgagcccagaatttattgcaactagttaataaactgacaattttctgctaaattagtggaagtaacattaaaacttagacaacagaagaaaatacagttgagttttccactgatcaataatatctggagtattttttaattatttccatttttttcctgaaattcctgagcttcagtgattttttaacttgaggcattaccttttaaaaagaatcttgagaaatttcatatcaaaaaaaaaagattgtagagacctcaaggggcccagaaatctaaatcatgttaagaaatgtgattacactcaagatgaaaagcactaatagtaatatcaataatattaatgacctccaattttaaaaactctataagaggataatgttcacatttctccagaaggaaaaaaataaaggccctgaatgattgcaagagagaagaaaggttatttttgttctacaccagaagagagtatttaaacatctagttgtcctgtaacataatgggaaacttggaaaatattggactcttatgccacatagtaactatgtgtggatttcttctcaaaggatcctttgatcctttaattgaaatttactattttactccttaatgattcaagaacacaattatagatattgaccgtaaaactacacaattaaattaaaagatggataatagtaacttgaaactaattttaaaatgtctttcttgcttattaacagataatggagcttagtttaccactgtctgccataatttttcttctcttttatacccatctcctccttttgatttgcttctctcaactttcttactgtcttttgtgagtattttaaggctcaggtgaaataaccattctaggctctgctccttaaagaatatctttttttttgttgtgtgaagcaaacagtttatagtatgtacttgaaatgtaacatttttcagttcttttcagcatcaatcattctctttgagtaaggtttttgttgagttctgtgttttgtacagtgctgctgtgtttgatagtttcttcttttgagcgttagattatcaagtcattagacactcctacctcacacctcttggaacaataaataactagcattaaccatcatccatgatagcatgaaataggcttacatcgttaatgtttatcttaggaaatgccagtgataaatttgtaagtgaacaacttaggacatgttctaatatgatacatatatttaacacaatttctactcaagcagtatagtagaaaacacagcttcaaggcaatcaaagggaaaaccatgaagaataataaagcttttaatttggacatattttcagtaattgaaaaggagcatcttaaatagctacataagtttacaatcaagataaggattgtttcacagctatagtgttgtatggatgcacactgaaaaatatggaaagatatgtctctctctctctctctctctctctcctctctctctttttctctctctcgattacctcaagggggttgaatcaaggagatagtggagggaacttttattttgcactgtaaatactattatacatttaaaatgtttgagtcaactatatcactttcatatttttaaaacacttttagaaggcacagtcaatatcatattattcaataaaaaggcaggaatgctaattatggtacacttctgattcctaatactagtgagtccaccttcttgatcctatgcttatatttatatttactttatttataactagactgccaatgatgaaaaaaattgatacttcccttttattagaaatcaaatccatgtgaaaattacagaaggtcctatttataatagcaaaagaaatttctttcatactaaagcatttatttcacttctctaatatagtcattctttcatttccaaaattacatggaaaactaaacaacagatgattgagtttaaagaaatgaagataatatagaaattaatcatataaaataatacaaataattgatatgatcttccttgtatagtaaaaaacatatattcaaagtacttaaatatggtgatgcctactgtgagaattcaatatatttcaccgcaggaaaaaaaaactttattatatatatcagcctttctatataaaggtattctcttagaaatctgctaaagaagcttatactgtagcaagtatagatttcaaaggctgaattgactagaactgtctatattgctaaagcatgcttataaacatttaattttatatacagtatggaaatagttactgtttgaatacttaatgcattcccaagaaaacattgaatgtctaagaatctattagccataataatttgtctgtaaatacaaattaattaataatagttcatgttaaatattttgataatttctgtcccattgaacaataatattgaataactttatgatgtaaaattctgtgccaagctgaattcaattgaccattaaaaaaacataaaacctgcatatgaaaaaaagtttcaacaacaagatacactatataaaatcacgtgaatttttacttgctcataatctaatttggcataaatctttgttaatgctctcttaaacagtgagaaaaccaattattgatgtttgaagatgctttcatgaatttagctaaagtcagaattctgcaaataagaatcattttatttaaaagttgttaccagctcagagaaaaaccattataactatttcctattgttaatattgtgtctaatagcaggggggtgctttgtattctttctatcagcaattcctctcactgctttacctcaaaacccaggccaataattcttttttcagaaatgaagggcctggtcttaacttcacagaataatagggccttgtctttcacttctctggtgatagttcacgtgcagccgagaggtcaggaattgaagccattaaaactgtagtcttctaaatatggtactttggattttgtggcaattggcacaaaatacatattagtaattataagtttatccaacatcgtttcctggattaatctgtattttaaaacttatatattttaaaactcattctatagtttatactttaaagcctattctatagttttatagaatattcagttataattaatttctattatcttattttaaattaaactaatttagatgaattcaatcagtttaaataacatgtttttgagtgaaattttgtactgatactttcataactgaaactgttatcaaactcctggacctggtgggaataatgcctctaggccaacatagattggaggagttctcttaataggttgttcataattatttactccagttataagaaagacattgtctgcttacatcattccttatgtacaatactttatccatgccatttttatgatgttgtatactaggtgataataatagcattgagaatttaatgtggtacccatcaagaatacttctagcttccaagtcaatctctaaaagtcaaacctttagattgggctatcatattaatacaaattcatagattgagaatcaatttatctgaaataagtattttattatttttagcacttgcacttgcttgaactactctaaaaaagataaagttgtaacttaataagagaattgtgttgtagtaactagtagctttcaatattcacatgtcatttagcaaatgagaatgaaaaattaactcttccattgatatgctgctttactcctttataaaacaatatttgggaaatttgacagagttttgctacagttgctgtatgtattttttgtaaagatttcttcgtgtgtgtgtgtgtatgtgtaaacatcatggttactcataaagctctgggtgagaaaaacctatttgcgttatgatcacttatatgatcataatgacaatgaattcattattccatgtgtaagtctgccatgtttaattttcttcgatctttgtttcagagtttgcatgtggtgcttactttagtagccactttcttgacattataaataatactgtttgatcttttctactatatactaaaatgttatatacaaaatgggtggtgttggtatggtcattggcattttgatttcaaaaccgtatttgattttgtggtcttgatcaaagaacttctatctatatcatcctgctacatatatttaaattcaagagataataaaaaatacatttggactttatcttgcacttatctttttaaaaaattttaactatcaataagttttttgccaactatttgatctgagctttcaatgatcaggcattagtaatttgacacttgtattatattgcaaatagggtataggttgtcctcaaataatgattgtcagtgtccataaatttatattaaaaatttaaaaaataagatgtggtcaatactttccaaaagtgatagttaacatcaatatattaccttatctaattttggccacgtacttgttagtataataaacataataaagtttattattttacaggatggtgtagatagaaagatcaagtatagatacatttaaggttacttgacctcaatatgtgtttatacattttttatggccatcatactattaatcttttttcataatactttgcatgagtctgattattaaataaggcttaaatatcatatttgaatgaactctaaatgaactacctggtggggtggtgaattcctttctagagattaaaccggtcaagctcctcagagtgcagcacagttgataaccctttgcctggagaaggagaagaagcagaggctgaacctatgaattccgatgagccagaggcctgtttcacagatggtaagacaaaaattgagaccttggttagcattccttaattagtgttctggggtttgtcttaacgcctaatacttaccagaggttgtcggtaagtcagaagactccattccatgctgattcagctatagctgtatgatgattaagggcaagtcactagagctctctaagcttgagtttccacatctatggcacttgactaacagtaatttcctatcactgtatgttagactgtaagcatgctactacttcttattttagagccttaattcgtattcccagatcaatggaaccaccagaatacaagttaatgaaagagtctgtactctggtccttttaatcaaaaatggaatctactcactaactctcagaaaactgtttgatactgttgactacagtctctctcaaaattcttcctttccttagtttcagaggccatagtctacctttggtcttttatttgtcttagagttctgagttcctctctctatttctttaatgagtattttttctgcacatcctgtaaataatgatttctccccacatgttcaatcttcagttatcttttcttattctgaagctctgaggtgtttcatgcatgcctgtggcttgaaaagccatttctgtgctattgactcttaacatcaatgtctttacctctaacctcactcttgagtcccagatctgcttacaattccccattggtcatcaccatctgttgtttgtaaaacattccaagtttaataagtttttttttttttgaaaagcaaaaacaaaaacaaaactttagtatggtttacagcttcctccagtctttattagtaacttcatgatctaccttaccctcaagctaaagactttgagagacccttaaagttttccttgctagtcacaagttcatcaggaactctggagatagggcccaagcccttaagaggatttgcatgcacactaaaatgtgagaatccttggcctctagggtaaagtctgaagtccttaacttgacatgtaaagttctttacatttggccttagtctcttgttttgtaacagtacctccttctactcctgtatgctttctgatatgctgaatttcttactacttctggaatttgtcagggataatgcagtattgtctgaacaagtattgtatcatctaggtaaaaatacaagcccagagtagggctgcaatgtaatacagtaatacaaagttcaaactttggagcctgataaacatatgttctaatttgccgacttatctgcctgtgagaacttgtgcacaatttaaaatcttgttcttcagatatctcatctgtaaaatggggatatcagcatccacatcacagcgatgctaagaggatcaaataagataatgattataaacttactagcacagtgcctatcttccttcttctacttttcttattcttcaaggattctgttaacaatcttatacagaagttatgatagcacagatgctaatgacttatctagtcatgggcttaccctcagcattagtattttttgaaaaatcatcgacttgctttcagtgtccaagattttctcaactggtttcttataacattcatgggttaagcaaaatgattggaaaataaagacatcagcaaactacaaagagtgcatggattttctttaaatacacaccaaatatcattttatgtaagaagcaaaggtgtacgacatccagtcaatataaattttgtgcttgctgaaattagtgctataagcaaatgcacagtttcctttaaaagtgtccatgttacagagatttaagaatttcatcaacatgtatggcctgctcctcaagaaatttattagcagtatatagacttaaatttgtattgatgctaccaagattttccctattcattttatgaatgatcatgacttaaaattctaggataactagaaagaagttgggcttatcaatcaacttaaagtttcaaaccaaaaaatgacttcaaaaaacttaaactcttacagaaagtattaatactatgctatttcagactgtaggtgctgttataataagatataatacaaagtttttttaatcctataaacatcaatgaaaatacttttgtgaatactctgagattattcattgcttccaaactgaggccagtatagaagaaatattatggaaacacattttccaatgaacctgggcttggaccattgaaatttactgagggagcatatatctctgagtcacatcccttttatgtgctccagcagagacttcatacagtctctggatctgtagcctaataaattcagtgaagcagccaatttgcttagcctttcaaccgtgtattcacataatcattctttattccagtaaacaaataattattaaatacctgtgtgccaggtccagttccaggcactggagggagatggagctgtgaacaaaacaataccccttgctgaagaaacatatcaagatgtagcaggtcagataagtgaaaagtgctatggagaaggtatatggaaaagaggaataccaagagtgagggggaagaacttactagcacataaatatgctatcaatgaatgattggtcagagaaagcctgcctataaaggtggcgtttcttccgtgatgtaaagaaaattgaagggggccgtgcaaatatatggagggaaagtattttaggcagagtaatgaaggcacatgccccaaggtgaggatatgcataacatttgggaaaaaccaagaggccaaaatagatggagaataatgaaagatgggaagaggattaaaagttaaggtcagaggctgggtgaagtggctcacacctataattccagtactttgggaggccgaggtgggcgatcacttgaggccaggagttcaagaccagcctggccaacgtagcgaaaccccatttttactgaaaatgaaaaaaaaattaattgatcttggtgatacatgcctataatcccagctacttgtgaggctgaggcacgagaattacttgaatccaggaggcagaggttgcagtgagccaagattgtgccactgcactccagcctggacgacagaggaagactctgtctccaacaaacaaacaaataaaacaaatgacattatttttaaaaagtgtagatcagagatgtagtagaggccagattataagacatttgaagaacattataaggatgtgattttaaaatctcacaatgtgcaatcttaagagtggaagggcgaatagcaatggcagaagctggaagatttcttggagtttctgcataaatccaggtgagaggtgatgggagcttagactagtatggtagagttttgtatagtgagggtgtgacatgctgagtatattttgaagttagagctgaagggatttgttgatggattgaacattgggtgcttaaaaactggaaatgcatagtttccacatgaagactgagaagcatgggcttgtcagaatgaagaatcatgaacatgtttacttacaagttggtaattggtctacaagagctgggctagaatcaatgccagttcagagcaatgtttcacctccagagatctctgctacctgaaaggtaacagaaaaaattaaatgaagtatgaaaaagaattaaatccaagtagcatgtttttactgaagataaatgttaaaacgattttgttgttcatagtctcacatttgttgattcatttcagcttcataattatcactttactaatgtatttcattgattgcatctggttcctcttattcaccttttctctccctcttatgcaaggttgttccttagctctgtgtctattactttgtatttgaagacttcagactgcttccgtatatcttgccctgttctttactatccttagttctacatgacttggcaacctatataattatgaacatgacatgactctttgggtctatgtggttttatattgtgctgcttttagattatcaaattagtaaattacataatcaggattagagttagcgaaaaataacctttttcacaaggtcaagagatcgagaccatcctggctaacatggtgaaatcccgtttctactaaaaatacaaaaattagctgagcctggtggtgagcgcctgtagtcccagctactcaagaggctgaggcaggagaatcgcttgaacccaggaggcagaggttgcagtgagctgagatcctgctactgcactccagcctggcaacaaagtgagactctgtctcaaaaaataataatggtaataatagtaatgtatttttctgttaacttggtaggagaagccaaatcatcttcctttcaaaatgttttgtattcacccccttcctataaaataactaataattaattctaactttagtaacacaataaccaactcctttgtgacttttattttttctttcttttggaaagataatgttaacaaatatttgttttagttatatttgatgttaagaaatggtgaaaaaagcttgttttcataatcaatttttaaattaattatattgatcatgctgttatggtttttaatgaatagtctgtcttttgaagtggtcagtggtttcttttttctttcctttccttttttttttttttttttttttgagagctttggtttaacatgatgaaactcagcatagactttatgtaatgcaccatgagagcacattagtgaaaccacccaaaagaaatagcatttactcactgggacccattaaaatgtttgagagattctctgttatgtttacattcaattaatagtccttttaaagagaaggtatgataacattgctaaccagcttagttggaaatctcttgggatatacctttgcacaaaaaccagacaggcgctccatcactcttgcctcaaaataagagaaagaaactctctgaggtgtaataaaccctgagggcaatatttatgaaacttcatttcagattgaaagtttactaacttttctaattaggatttttagtgtttttatttcctcaatcataagaataatgtttcccttcaattttaagattgacaaaagtaaatcccagagagcaaaatcttcttaaccaaagggataattttcttatccaataatttgcccctgagaaagataaattctttcttatatgtgatcattgtttttaagtttaagacaaattctaaagcactaagttaatattaaaaaattcatctcatttttttcgctctctctggtatttttattttccctgaaaaagattaacttagagttaatttttgaccctacccttttactctgtttttatatcattttatcgaatgttctctcttaactaaatgcatgtagataataattatttaagtataggatgatacataatttcagatctgagatcatgttcactgtaattaacattgtataaatgaagctatgtgtagattttccattcacctttttttttctttttcatccaatgtttatgtaaagtatagaattcacagagatgtaacctttcaaattatgactaactgcttagaagattatataactctttttggggaatcaagtcttttaaaaatcaactataaatgacctattaagccaagtagaggactatgatgagtactataagcacaaagagcaagcattacagactcagtttgagtcttctgggaacttagaaacttccagagagaaaaaacaggaacacataaaatatacatgataacaaaaacaccagagacatagggggagagggaaacaccttgtttgctgtatttctatagagctggaaattaaagtgctagaaaataaccttatatcaactggatcaatgcactaattagacttcagaaacatgaaaagattcattacaaaacattttctaccaggtgcatcttgtcaagaggattctagttttgttgttttagaacatacaacttatgattatctgaagttgttacttgaaaactcaatacttgttaatgaattatattgttttacagaaaaggagatcaatcttttagaaatatctaaaattcaaacttctgaaacaggtatcaaaaaagtgctgcccattcttactttcccacctcctgccttcatctaaaatgaggtttttcatctaaaattttatgaggaagaattcactgtagttactttttaaagagtctctcttttcttcagagtaattctagttgctttaataaactttaaattgattaaaatttttcaatgtttcaatcattctctttctgggcctcttatgttcatagctctgtttatcacttcttataaaactttttactctttggtttctcttttactgcaccctcttggtccttcttgttcatctctcatttcatctacttcaaagttttctcctctacctgtcctagtgatgtgtaggtaaatatttttataaactggttctccaaggaaaataaaaaatgtgtacttatatcatttactataaattttactgatattaggatatatgacacacaatttacaaataataaaatattacaactttttattgaacattctgtatatcaaattgtttctcaaagaatgctttttttgaactttgccaaacttttgcatgtataggcaacctatttttgcagctaataaacaagtatagttttagcatgaagactgcttgatatttatgttagtcagtgaaataaaaaagaaatgaagaagctatatgtcagaactttactcattcatcagtgatgtaagcaattatttgcaaatcaaaaaacagaatttcaataatgaaaggatattttttaatttttgtgctattcagagtaatggctacaaacacaatacaccttgactgtttatctgttttattggcatttcctccatcaccttcttaattctactctagaaaatcaagaagctctcatttgtagtgcttggagatttttgtaatgtaaagattcccaccatcactgatttcaaactactgatgtgaaattgctaaatgcagagttaagaagagattcacagtagctcaacagtgtgacatacttccaccatccagatagaataggccagatagaatagaccagcatccagaaagaagagttgcacagtagcccaatagtatagcatattactactgtccagagagaataatccagagagaatagaccaccgtccagaaagaagagatgcacaatagcccgacagtatgccatacttctgctattcaaacggaatagacaaataaaatacagtaaaataattaggaagtgatatgtcttagtatttattacctttccttaaggtaagttatagaattctaagtttatatagtcaaatatttaataatggctgcttttaacaacagacaagcaggaatttctgacagtttaacaacaagaattggtatggtctgctttcagcacaccattgaattctctcccttaatattgttgtttcagaatgtttcggagttggccctttttctgctcaccctaaatactctttttgtgtgacctcaaaaactgttctgacttcagcagatacatgtatgctaattattactaagaattcttttctagacaggtttttcccgtttcaggttcccacccccatttttaaaatctataggatatctgtatttaaacaattcacaggcatctcaaaatcattacctgccgagtcagctcctcctcctgtggttttcaattcactgctaacatccacctggtagtcctgggatccttcctttctcttacatttgatatccaatcaatcaccaaatcctgctgattttatctgccaaatatgtcttgaatctgttacaactctagttcctaactaatctttccctccagacaggatactggaccagaatccaaatggttttctgggtatgaaactttcttcacccctactcctctctattcacccttccaacttatcctccatgtaccgtggagacatctatttacattgcaatttgcgtatctcgttccctgcttataaccctttacttactcctcaacctcaataggatataagccaaactccttaaggtaaaggccaatgctttccataatctgaccaatttttctaagctcacctctcacccttgcctcttgtgtacattctgcttgcatcacaattctaaactggtttaaatttctatgcataacaatttttgctgcctggaattccacccaaactcttttttactgatattttgattcaacccaggctccatctcttctaggaagcctctactgatctctctttctcaagaaataagccaggtgagattgatttcttccatgctatcaaaatgaaccctgactatctgtcactttagttgccatatctagttatagtcatttatttctgtttttatctacctaaccaaaacctaacataaattcactgaggaaaggaaatcatgtacagaggtgaatacataaaagatacgtaacaagggtttgatggacaaaagaatgcgttaatgaatgaataaacctaaccatttttaagtacaattttcaattttttgtagcagtatattttgtacataaaaatttaaagtcacatttgtttttaacttagaatacttgaaacagtttcatctggatcttctaatcaagatgagtttcttttgaacttaatttcaggagtttccactaattttctcaatattgtttagaaaggtgtatttcagagggtttttaccatagaggagtggaagtatctaaaattatagactagaaaaatttatctgtcagaaaagaagaccctaaaattcatgtcgtcttcagattttagttcattcattcattcacacataaaatgaaagtggtttaaagactgtggaggagactgaagagaaattggggattacagaagacaagaatacattgtaagctaaaactaactaacaactatttagaaaacatcatgcaaagttagaagatgaaggaaggcagcatccaaattaaatctatctgaaattgcaagtataggtgttgaaattatttggttgagggagtatcacagaaagcagtttgcattaaataatgtattaaaaattttatttattctgaatatcaagatttaacatgcatgtctttcttgtcaggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggtaaatgatctgacacctaagtcaatatattgattaagtcaatattctttaaaatgagctaaaagataaaaatatcatggcaagttgttttacctagaattaatccctatgattagtgccaatgacaaaattttacttgagctcagtaaatagttactgagcactcctacatgccaggcattatccttgctgccctgaatgctgttgtccaaaggaccacccagatggctataatagaaaagagaattttactggcaatatcagtttgcaaaacagggagagagtctgtggcataaactgaaagcactttccctgtagaacaaagagagaaggttagaggttttattaaaatgggaaaatgttatatattgctctttgagaaagttcattggccctagtaaggatctggggaactggtaagctccaactggcgagcaacagtcgttggcacaattagtcctagagtgtaacaggtttcctcagaagctatagataaaactaatttcaagttacaacaagcagcttcaacagtcagtcttgcagagaattataattcttggagtaatgttttgtaccctgagagcttttccccctgccttcttgactcttagttgactgttagttgagtaggacaagaactacccaatttgtatgatcaactttcacaatgcaaagataaataagatccaggtactgtttattcttaaggagctcagagcaatggagaagagaagaatacaaatgagtaactgtagagcttggatgtgtttgtaagcaaagtgtaaatgtgacaaagttctgtagcaaggagaacaactgcttgcaatttcagaaacgtaaatggtgcttttcagggtctagaaagacgaacaggaattttctagttaggcaaggcaggctgaggggaacaagtatacaatcgtaaggaggcataaaacagcatcagatattcaggaaattaaaaactgctgaactgcaagtgtggtgggaagaagaacaagtacaggtggccagagatactatgagaaagcaaggtcagcttgtgaagcatcttgtgtgttataaaaagggaaaacagatggtagttttaggataaaagtaggacaagtttctcattcttgtacacatacaagcagcttccatgagagttgaaagagatctagtagaattacaagctacctgaacctttttcttaattgtcatttttcctgctgacgctgacagagatgagccattagaagccattaggagcccagatctagctagatataccactggaagtttcattatactaaaaatagaatactcaagaactttgtaacttgcctcatagacagtcttcatgagtttggactttgattttactgtacttatatgctaataggttgatctgatactgtttcatggatgctggcagaagatatgaggtgcttgggtcagagataaaggactttgttacttatgtgtggaaagtagcatgagtttcaacatgtttctgttggttccccctttacccaggtctcatgggggcattatatgagcctgaatgagtgtgtacacatatagtggattgatgtcacagctgaggaacactgagcttagggaatgcatccttttataccaagcaacataagcaaccctgctctttgtcccagagaccctacctcatgtctcaaggttgctcactgcaaacacaaccctgaggaatgtcctaggtaaggagcaggcagagcctggcattcttggcacactccccaacaacctgcagggacccactgtggctttcctttcctatcaagtctcaactctcagaaacagaaaatgtgatcagaaaagctctattttccttacctggagtcatccaagtagaaatcatgatagtgtctaccatgcaatgtattcctagtaactaaggaggtttatcccatgctgactcacatatgtgactgagaatttcagagaggagattacaaaaaaattaaagtttggagtaattccttgttcaaaatgtctaaaacagaggaagacatttggggagggcattctcaaaagtgtattttaaataaatcatatgaggaagaaaagggaaagatatttcaagaagctggtgtttgtacttagacaggttgccaattaaactagattttttaaaagtatagcaaacccccatgacacgtgtttacctatgtaacaaaccttcacatgtaccctcaaacctaaaataaaagttaaaaagaagtaatagctctcatttagcttatacttattgtgtttcagaatcttcttttagattttctcatttaattttcaaacaaccctgtgagattatgatattttgcttattttaccaatgatgaagctgggtacagttttaaaagttgcttaatgtcccaaagctagtaaatgacagagctatcactgaattgacatctaaaatcaaagtcaccatatcttttcactgtgttgtggctcctcagaaagaagagtatacacaaaacagaaataaatgagtggtaactgaatttagtaacagtaaagcgttaagtcctaaatcagatagagctcacataaggtcattcttgcctccttgctcctacatccacaaaattggttctggaagctagaacccctgtgggctgaattctaattcctgctctgggaccagtcagagagaggttctcatcatcaagacttcctgcggctctgctctgaccctgtacaccagttctagaaacaggcttcgttttccttgtgactaagccccttccttgtctttgtatttcaaggactgagtcattgccatagtttcggtttagatggcttgcctgattcctccagaatttgggggtggagtggaggggaggaaaatcctgagggctagaagcctccctctgcacttcaattccattgaatttcagaacctctgccaactgctgggaccttctttttgcatcttagtaggtccattcagtctttctgccccaacttgtctcttttcttcaatattgataccaacagtttcccaaaactgctaaggataattttagagtattgaaagcagaacgtagaataagaagaatctgaatggcacaagttcatgactgtagacaggtaataaatataatattaaccacgaaggatacaggtctttgactttcattttatccaacagggttaatagtgtttcgatctgaaagagaaagttctaacactttagacctgttgagatcagcaatcattttcagtgtctcaatgagccttttttttttttttttttttgagacagagtcttgctctgttgcccaggctggagtgcagtggcgtgatcttggctcactgcaacaatgagcccaatttttcagtcctttcaaattctttgtcaagggacatgtggctgaagtctaaagtcaaagtcaccctgtcctttcactgtgttgtggctcctcagacagaagagcatacacaaaataggagtaaatgagtgataaccaaaattagtaacagtaaagcgtaagccctacattagatagagctcacctaatgttgtcacataatgttgtgtgtcacttactaaaatttcttggaaagcataggaagcaccgcattaatggagagaatagaacagtgatttttagagctgaagctttgaaggataatatatggatgaatagtcaaaggaaaaagcaccctctgtgttctataggcctattaagctactgcagtcattcatttagcaaatctttcctttcctgctgctgttattaacatggtactaggcactgggatgcacaagcatttgagagctgaaagacaggctccacatcctactggtggggaaaaaggggagtgtaggatgtgaaaagtttataacagtggctggccatgggatcatgtcttaaattgctaggacttatccaattttaatggagaaagaggaggaatcagatggaggtggaaatgatcaggtgtcagagatcatgagtctttttgtggattataagtaatttcattcttttgcactttctcttgacctctgaagaccagcagcagcactggtgagaaggctagaactaactgttatatgataactgtaaaccagaaaaaatgtcagctggcccatgtcaatattatgtttcagcagtcttagcattagaattgtatttttcctgttttttttaaatgaatcatgaagcttaagttgtgcatgattgaaacttgaatattatttccacaggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtaggtacttttgagtacattttaaaagaggatttattcttactgtgtgttgtgaaaaaaccttcaccactattgcatattatcatattttaattttgttaagcttcatatattttcaggctataggtttattcttttagaaatattaacacagccagtggaaatatatctgtgaggaatattagaacagaaatcgttcaacaaatgtaaattatttctgtgacattgtaacatttataattgagttttttatgttttctgcaaaggagatgtgattttttaaaaaatatgatttgaatgtcattcttgttaagaataaaacaaaatttagaagtaggagatgataaaagggcagagacacagattaaagagaggaaatgatgattattcataatgtaaaattggaagataagagaggatgaggggcacatcaagttggctgatatgtgagctaaaatttttctaaaaatcattatacaaatacaaagttaactttgtatttggggagagagaagtcatgaaattttaaaatatctatctcagacccaattataggaaaaaccaaaatgagacacaattgtctctatctcaaatatgcgacttgcccttcatctccagaatggcagtggggcagaggagtaggcattattattaatgtaataattttagataataaattcaaagaactgttgaatacttggatgatggaaaatacataataattctttagtttacatattattttaacgaagtagaaatatttttacaggcttctgattgagatagagaagaaatcttaaaatagtcggtgagatcaaggactctcaaatagaaactaacggtacaatacccattattatcatttcattgaatgtactctaattattttatattttaataatataacttaataatatatatgacatattttgtattaattaaaatggctttcttacattattttataacctcaatctcccagtcttatttttctcagaatgatatgttctttatcttttactaattcttctagattttcagaaacctaacctttgtgtttagggaagaaacatcctataatcagtcatagtttttagagatttgttttccatatgatgcctgacataattagaggtcaacacgcaaatttgtatatgccaataagtgctttaaaatttaaccaagggtttgcattatcgagcttttaagaaaagttgaattcatacagcatcatatgtggattagaaaatcacaagtaagcatgatcatacatagtaaaatctgactgcaaaatgttaccaaattagtcatatttactcaaaagttcaatttctcaactgttattcaaagcttcataaacttttggcttctggccaggcgcggtagctcacgcctgtaatcccagcactttgagagtccgaggcaggtggatcacctgaggtcaggagtttgagaccagcctggccaacatggtgaaaccccgtctctactaaaaaatacaaaaaattagccagacatggtggcaggtgcctgtaatcccagctactcaggaggctgaggcagaagaatcgcttgaacccggtaggcagaggtttcagtgagtcgagatcgtgccactgcactccagcttgggcgacagggtgagactccatctcaaaaaaaataataataattttcgttttcttaatcacacaacatattaaatgttaaaaacaataacttttttctataatatgtaatgtgaaaaaatttttaacatagctatatattacaccttatatgtgttatcttaggtttcctctatgagaattctaacttcggatatagtaatgatttcttgctatttttcaattaatcattcatatatcaagttatctagttactgcctaaaaaatgaaaaatgataaaatgggtatttttgtaatatagtagttttgaagaaaggctgccccaaataagaagaaattatagaaggaatgtagattttcttttctcttaaactgtaaatatgacggggtctctctcttaaaaaattatacaatattttagatattttaaaatctttaaaatattatcacaaatacactcattttcatcattcagtgtaagaaatgaaggtttacaagtaaaattgaacttattttaaattaagagatatggctgtttaataatggaaattgttttatttgaaaatttaaagtgatgattctcagtgagtataacctcctgttcaggggtatgtaatgtgcagaaatcagggagataaacaactccaatttgaaatattatttaatattttggaaacgaacaaatataatgcaaagcacagagagtaaagctccacacaatattcttgctgacagagatgcaaattttgggacacagatttgggggagtggctgattttttttttttctgaaaagtatagaaacttatctacagcagttgttcttgaaggatggtctcaaaactgaaaacgttggcacatgtaggtgagaactcataagagatgcaaattctgcccccaaccccaagacatactgaatcagaaactctggggttggatgtggcaaatcattgtaacaagccctacagatgattctgttgtatattcagatttcagaactacttatattatttgctactcagagaatggacttgtctgatttctgcaggcttctgggttatttgaaacttacttgattaaacagtgttcttcagtacaggcgtatatttgtatatatacgtgtgtgtttatagaaagatgtgaatatatatgcatatatattctcagttacaaactataccatagtcttaataatatgcatatattccgtgtcataaaactcacttaacagtggcttggagaacagacctattagtattttaggggctgtatcaattataacagacatgtcttagtctaccttttattgctgtaactgaatacctgagactggttaaagtattcaataaagaaatttatttcttaaagttctggaagctgggaagtctaaggtgaagggtccacatctggtgggaactttcttgctggtgggcacaccagagagtcccaaggcagctcatggcatcacatggcgaggggtgttcactgagagccaaactgggttttataataaacccactcttgtgatatctaactcactcccatgataacccattaagcccttactctatattccattcatgaaggcagaaccttcatgacctcatcaccttttaaaggctctgcctcttaatactgttacattgggaattaagttccaacatgagtttcaaaagggacaaacattcaaaccacagcaaaacattaaaaaaaaaattttctgattaaagagggagcatacatattttcaagtgttcttaagtggaaaataatggatgtgaatgactgggcaaatttaagagtggcatgaggagtaatttattctgctaaatacgtagctttaggaatttaaaaaaaaaagccatgttacatttagtgagacatctggaaatactacatgaggatgagcactttaaaacacttcccgcttcatcagtcagtttacctgtctctgatggtaacagcaatgaactttttgtgaacaatgactttttctacgcctgaaatagataaatatataaagttggctctcatctgttcctattcttccctcgaaaaattgaatctctcagtcactaacttattcgtaatgaagaactgcattccagacatttttcttagacatcgtctcctgctacacaggatgtgaggcaaatgaatattttccatggaactaattcagagagtaaacatatttatagatccagatctaaggtcatggaggagctcattgctttgtaactaaaatgtgtattgattgtattgctgttcatgttctttcttaagataatttacgataagaactcaaatttcttttggatactggttatggtaattgtggctgatctatctaacatgatgaagctcttattatatctatattgattgtgaagccaatgagatcagctactctcattctctcttcagtacaattgtgatttttctcccatgaaaaactatttggtagatctttggtgctaatctttagaaattgtagggcagaagcaatcttgttgagaatttgccccaactcaaaatcatgagtcttcaaaatgttttttaataagatttatactaagacatagatttagttgagtgaataccacacttttagggcttagcttcagaatcacacacttcattttgacctgagttttataattaaaatgttcaccattgttctaattaaatttttagatttaataaggaattacaaagcaattgattacaaaagtgtgaaaagcatatgcatgatttctattcaaatagaataaacaacttactttgcttacattatttcttcttattttggttaaccttcttttaaatctatttccttacagaaacatccatcttaccctatttttaggcattgactacacaactccgtatataccatcttattgttcctgttgagttgcttttagtgagtttcagaattgactttttccttttatgcttcatcattttattgacacaattaatgaaaatgttatttttataggtttctttggttactttagtggcaaacactcttggctactcagatcttggccccattaaatcccttcggacactgagagctttaagacctctaagagccttatctagatttgaaggaatgagggtaagaaaatactaaactttataatgttcttattttttaatggggtttaaaatataaaaacaatgggtatgtagaaattatgagttgtttctgtttacataaatacataggctgtttatgtatgtgtgtgtacatatacatatatacatatgcatatatgtatatatgcatatgtatactatatagtatgcatttacatactatatacagtatgcatatatactatatatagtatgcatatatggtatatatatgcatattatatacactaatagtatatatatgcatattacatatactaatagtatatatgcatattatatatactaatggtatatatgcatactaatatataaatactaattatagcattaattaaatagtatattactaaaaatagtataatactcattagtatatactagtatattactaaaaaagtataatactaattagtatatactattatatattaatatatacagaatatgaaagactatatataaaatatgcatatatagtatagtatatatattatttcatttactgtacatattagtatatatatgcatactctctctctctctatatatatatatatatacacacacagtatttcagtgcatattgtttaacaagggaataagttaatcacagtaatcctgcctttatctaatattgtcaaacaatagaatgatccaaatgagtgacttttttcatattaaatggaaatcttccctgtgctaggaagtccaagtgaaaggggaaactattgttcctaacatcatctctcatacataagtaatcaaggacctacttatatcaggtgttcaaataatatttgtttaagaaactacctgggtaaggagcattagaaaagataggtaagtgagacagcatcagccatcacatttaatttcacctttaaaataacattgcaaagtaagtggaattataactaaattatatttgagaaaactaaagctcagagagtttacttaatttgcacttaggctgcagagtgcctgaaaagatactcaattagcagagacaaacaagttataatgaataacaactaccataacctagctttaaggattgtattaaaccagcaactttgtaacacacatggaggacaacaactctattttctgtaattagtccatatcctcatgtgttggtactcctctaaaatttcttctccagatttatacctgctattttatgcctctgttctggaatgcttcccctgccctgtcccgaccctaacccgtttgtatagcagacaaacacctatctgtcctttaaggctcaatttaaagttgccttgtccgtccaccaggagacataactggatattctctctctgttcagacacctaaaatcctcattatattgtattttacttatttgtttacttaactgcctccctaccttaccttctctgagcaatttaacacggagattagtccagcttactgatactttaagtgtggtttactgaccagctattagcattatctacaaacttattaaaaagacggacggatcatgaggtcaggagttcgagaccagcctggccaatatggtgaaaccccatctctactaaaaatgcaaaaaattacccgggcatagtggtgctcacctgtagtctcagctactagggaggctgaggcagaagaatcgcttgaacccgggaggcagaggttgcagtgagccgagatcatgcaactgcactccagcctggggaacagagcaagactctgtatcaaaaaaaaaaaaaaaaaaaaagcaaattcttggatctcaccccagacctactgagtcagaaactccaggatggggataagaaacttgggttttaaccagcctcaagtgaacattagagatctttcagcctaccaaatcttcactgttatccctacaaacctaattatgactgcaatctctgctattttaattatccagtgtataacggtttccaagtataaaagaaagatcatgattatacaaaaaagttcataagcacaattcaaaaatattctatctacaagttgaaaattacaagtttcattttgtgcagaaaggtggtattagaattcattgacattaacttaattttttgagcattaatagaatgttacaatctatcacaactttcccctacaaaaccacttccttcagtgattaagccagcccactatttaactctgtttgctctttgttctttatctgtattacaggtgaattggatgcaggagaatagtttagtatattttgagaggcaaatgtctatttagttacatttgttaaccatgcaaaaagagacatttattcatgccgcagggctattttgaaggataaatgaaataatgaaataatgcatttgaggcatattgtagtcagcttgtttgagtccttaggctctttagctttcccaactggcttctcatcagaccaataggtgcctgtctttctcagagacccatgattccatcattactcacattttttagaaaaacattttaaacaccaactatgtgtcaggtgttgtgatataaaaaacacagagtacagtggtacatagaccccggtccccaaagagtgagtagggtcaatggttacaagagagacagacaagggcacataatgatacaggaatatacagtagggagtggctatccggggaagtctgggaagacatcacaaggaggtgacatttcagacatttcatgactgaagagtaagccccaaatcataggcagataggcattcaaggcagtgataccacatggtagggaggcacagaatagattgtgcaaggtgtgcttggtcagtgactagatgtatcagagtgcctacgtgataaacatagtagggagggcagcaggaaatgagcatgaaaaggtaggctctattaagagctggctactttgaacttcattctctattcctattcctcctaatcttttttgaggtcacatagactgtaagaatctgatgaaagttagaattgtctttccggaaagacagcacaaccataatgtttgttatataatttcatgcccccaggaaacctctacaggtccatgaactccaaataatcattgctctggaccaaaggtcaacaaaccccagcctgtttttgtaaaaatgttcttggaacacagccataccagtttgtttatgtatgacccatgactaccatggcagagttgaatagttgcaacggagatataacccacaaagcctaaaaatatttataaaaatgtttgcaaaccttctccctagatgatctgattagtagtcagagatccttagtatttctctattttaaagcatcttgagaacctgcttaatacattgcagaaaagaaggatcccagtgctccttccctaacaggttaatctttaacacatttgtacttgaatgggtgctcaagctgaagtgtaagatgacaggtaggttttgaaagattaagtaaataagaaaatctggagagtgttaaatgccacaggaattgccctggatgaaaactggagtggcaaagacaaactggtgatcaatagcagtacaaatgctgaaaagcagaaataaagaaaggattaaagaaaaactgttcctaatttttgtcttaactgaggccagcactatatatatttagtcaaaggcttacatataaagtatttagagtaataataataaatttaaaacgattgctcttatttcgtagaaccagccaaatctaaaggatttaaaccatttaaagattctcaatccttttgtggagaatgtctcaaaaaaagagaataagaaaagaaaataattaaattaaattaaaatgatgtccagtcataattccacctacctgatatacaccaatagtttctctatgggggaatctttaatgctggtaataataggatcatgaacatttaaatgtatataaatatatatttttcatttatgtttatacatttcttttttttccagagtgtacagattttacaagtttaccttatcaataacaggttttggtttattatttttatttattttacatttatttaagctattatattatcttagttattttgtcttatattttgctaacaattttattgtgtgataatcatgtaatttgtaagcctggtgatcacagagttcatgtcttattttgtcttgcttggcacactgctgagtgtagagtaggcatttaataaacatgagtcggctggttggtttgatgtcttagatatttaagggcggcttttctaatttatttatgtctgcatggcatttctttcatgttgcctatttaacatcttactaatcctaatcatgcttttctttcttttgaatactaggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgtaagtgtcccatttcatgagtgcttggtattttaatagatattggacgaaggatataagttattctttaaatagtatattaattataaattgaagataaaatactgtgtggtttttaaaacagtgccagtcttggccgggcgcagtggctcatgcctgtagtctcttcactttgggaggccaaggtgggcagatcatgaggtcaggagttcgagaccagtctggccaacatagtgaaaccccatctctactaaaaatacaaaaaaattagctgggtgtggtggcaggcgcctgtaatcctagctgcttgggaggctgaggcaggagaatcacgtgaacctgggaggcggaggttgcagtgggccaagatcgtgccactgcactccagcctgggctacagagcgagactcttgtctcaaaaaaaaaaaaaaaaaaaaaaaaaagtgttggtctttcctagaacatgttcctacatgaataagaagcatgggttctgttgcatttgagttattaatttataattgactctttggtgtcatgtggactcccatcttgcaccattcaaatattgcttcaaaaatgaacgtttttgaacttcctgcttcacactatgaagggatgagaggaacttcccacaggcatggagaaccctttaaaaaatggagaaaagatgtttcctgtcttattcataaaattttccttcacctttaaaaaataaaaggttatgtgcgaaattcacaggcaactgtaacaatttagaaataattaactgggactaagatttagaatgttacttgggaatatgtcctttttaaaaaaatctttacattaaatggacatgttgaatacagcaaaacttactagtattacttaataattgtggtaacattaaacagacaaaactctgtttatggctattttagaatatgagcttaacattcaaattctattaatgttattcttaaaggcaacttttaagggatggacgattattatgtatgcagcagtggattctgttaatgtaagtattgattatcttagcactaaactttatttttaaaagcttcttagtttatttcagtgatttccaaactataacttcatgaagcccttgggactcacatagacaatgaagaacatccacctgatagtagcctagtggttgtgagtacagcagttggagatagagcctgattcaaattctagctgtaccatatcatccaagctctacaactgacttcgggcaaattaccttaccttcttgagacttagtttatttgtctaatctataatttaatgaatctatcatttgtctaataaatgtctacaatcatccaatgcctactccatagtgttgtgaggacccaacaagaaaatagaagcagggcacttagtgcaggctggcattactaaatgctcagtaaatatgcgcttatcaaaataaaaataaaataattttaatgtatagcttttactgtttttacagtttaaaacaccttggatgagtttatgtgaaataagttccatgctaagaaactttaatgattactccctaggtaatatttttacaaaatataataaagatgtattcggaatcaaaagaaaatacatggcaaaatgtgtataaatatgataatgtctcatttacagtacttttggaaataacatatacatagtatgtcacttagttattgaattttcctaccaatatgagcacaaatatgcatatgattaagccctttgtagttatttgaagattatattatttattacataagtatgtaataaattaaataataagtatgtaatgaatacatgttgaataaattgttaagagtgattatgttaaacctcaacaatgctatggcttcttaaatcctatgtttacctaggatagcactgtttgaattacctggtcaaaccatgtgaaaaagaaaataatgaatgttactgtccatataatgctaacttttgtaaattttataggtagacaagcagcccaaatatgaatatagcctctacatgtatatttattttgtcgtctttatcatctttgggtcattcttcactttgaacttgttcattggtgtcatcatagataatttcaaccaacagaaaaagaagataagtatttcaaatatttttcattgtaatgaaagggatgaacaattattttccaaaaaagataatgtaaagtttaatttgatatcaattcatgattaattttattagaacttcatttatttttcaaataattgactagtatacaattacaaatatgcttaatcttattcatttttgcacagaaaacaattttctaaataataggttctggctaacttatgatttaggttaaacccataggttttgagcaatatatcaactattctgttttttccaatgtttcctatagaggattgaataattaagaaaaatcaatacactatttattcaaaacacattttataagtagttatttattttattttgtgtaatatatattgggttggagcttggggagaccaacgtaagatatggttcctgagctcaaggagtttatgtcatagcagaataaataacacaggtaatgaaaattaagacttgttgaatactgtaatttgagcaatcttctgaaatttttaattaattaatcttcacatcaactgtattagtttctttgacctacgagaacaggataatacaaacctgagggcttaaaacaagagaaatatattctctcacacttttggaggttagaagtccaaattcaaagtgtcagcaggtccatgttctctttaaagcctctaagaaaatatattttattgcctcttccagcttctggtagcccaggtgtttcttggtttatggcaacagaactccaatctctcccattatagtgacatgccattttccctctgtgtgtctttctcctctactagtaaggatgccagtcacactggattaagagcccactccactccagtatgacttcatcttaattacatctgcaatgacattattttcaaataaggtcacattctgaagtgctaagggttaggacttatatgtaccttcttagggcacacaatccaacccataacatcaatcacaaaagtattattacagagtctctttcacaaatgaggaaaggcacacagaggttaagtgacttacccaaggtcatatatcgagtatgtgatgaaggttagatagagtcagtagtaaattcgatgtatcttgtactctattaaactctctactatgctctatccccaaatactataatcatgataaatacaataagaaaaattaacaagcacaaaaaatatacatgacagtcagagtaaaaatagatgctgctatagaatggtttatgaaatacgtgacaattgagaaggctttggaaggtgggaaagaagacatgtagcaacggagaggcaaaagaatggctaacccacatggagtgaaacagaaatgaatgagcaaatgaattgtgttgataaaagaggcagcaattcaggggggatagcaatgctttcggttttgaagaaatttaagatttggagaaatagtaaaagatgaggttttaacctgcctgagagtagatataaaaagccgtattagaccttttttaatagcagctggtgtttcattcatatatgttgagtagggaagaatatggaagcaggagattgatgtttattaagactccatgatatgtcagatcctgtgtaaaatacttctaacataattgtagtcaaattttacaacaaatctaaaagacatagtatcctcatttaacctctcagaaaaattatcttatttgcacatggcctgacagctaaaaagtagtttcattatggatctagctccagaattgctttttctagagactgagctttacaaaaaattaatctagcagtgatgcacaaaatgactagggaaggaccaaagactatttcagaccctgcttgacctgccacctggaccacactaagtctccaaattagtcctgtgtgtcaatggagaataggaaatatgttccattaaaacattttagagggtagaatctacagtattgcttgtgatttgcaagagataaaggagtctaattctggagtttcttgtcaactaactgagatactctggttgtggtaccacctatacaaaaagagatctttggagactaaatggtagaattacaaaagagaataataattttgggtactggcttagcatctaagaagacagatgtacatgtaccaaaatgtcattagtgtgcatgattgactatttgcaagtagacaaaaatttagtaaatattgcattatttatcctgacatttacaaatacagatgtttatttttaaagatttttaaatttcatgttccattttacatttataaagtgtacactgattttcaatttatttttctcaacttaagcattatatatacatacatgtaatatataagcacacacaagtaattcctcagtcttccctgcataggataaattaagcgtgtctagaaagagcagtatgagcataaataaaacagccaacatccaattgactttaatcttcctgcttgttaatgttattcttacaacatttctactgcaggaagtaaaataggatgggttgatactatcaccaccaaagtcaggaaacagttactgatttagaagcatcaaaaactcatatcccctatcattcttccagtatttcatcttgcaatctaagtatagcttttattttctgaccttttctgaatgatttagaatttctttccactcttccctgaaaaaacatgaccaacacttcaattagttaacacatgctatgtagaagtacgtagtagatgctttgtgatgaactcatttattccaaagaaaaaaaacaaatgaaagtggtatccttttctttgcctttcctaattttaattattgtggtaaggaaacttaatatgagatctacctgcttaacaaaatttttaagtatactatatatattgttaactatagttacgaagtactacaggaagtccctagaacttattcatcttgcataattgaaactttattcccattgaatagcaattctccattctcccatcctttcatgccctggcaatcaccattcttctctctgtttccatgagtttgaccattttagttacttcaccgaagtggaattatgcaatattttttctgttacttcactcagcataaatttatccaggttcattcaagttgctgcatatggcaggatttccttctttataaggctgaatagtgtgtgtttgtgtgtgtgtgtgtacgtgcacacgcacatgcaggtatacaaataccacattttctatcccatcattcatcaatagacatttaggttgttttcatatttggatacagtaaatagtgctgaagtgaacatggaagtaaggactctgagatcctgagttcaaatttttaaaatatgctcagatgtggcattgctagatcaaatggtagttatatttttaattttttcaggaactttcatactgttttctatggcagctacatcattttacattccaacaatgtacaaaggttctaatttctccatatccttgccaacacctattatcttttgatttgggtggtttttgtttttgttttggtaatagccatcctagcaggtatgaaatgatatctctttacggttttttgttgctgtttttttttttttttttttttttttttgttgtttttttttttgagacggagtttcgctctgtcgcccaggctggagtgcagtggcgcgatctcgactcactgcaagctccgcctcccgggttcacgccattctcctgcctcagcctcccgtgtagctgggactacaggcgtgcgccaccatgcccggctaatttttgtatttttagtagagacggggtttcaccctgttagccaggatggtctcgatctcctgacctcgtgatccgcccgtctcggcctcccaaagtgctgggattacaggcgtgagccaccacgcccggccttgttgctgtttgtttgtttgtttttgaaggagtctcactctgtcaccaggctggagtgcagtggcgcgatctcagctcactgcaacctccgactccctggttcaagtgattctcctgcctcagcttcccaagtagctgggattacaggcatgtgccaccatgcccagctaatttttgtattttcagtagagatggagtttcaccattttggccaggatggtcttgatctcctgacctcatgatccacccaccttggcctcccaaagtgctgggataacaggcatgagccactgcacctggccctcattacagtttttatttgaattttctgatgattagtgatactgagcatcttttaatatacatgttggtcatttgcatgccttcttaagttgcaggagttccctatatattttggatattaaccatttattagatatatagttggaaatattttctcccattctataggttgctttttcaccctcttgaatgcttcctttttttcccaaagctttttagtttgatatggtctcaattgtctatttttgctcttgtttgaattttggagtcattgccaagaaatcattgtcaagaacagtatcatgaagctttcctgctatgttttcttctacaagttttacagttttcaggtcttaggtttaaatgtttaatctattttgagtttatttttgtgtatggtataatataagaattcaattttatttttttatatgtgaatatccagttttcccaacattatttgttgagtggcctcttttctattgtgtattcttggcacccctgttgaatatgagttaactatttatgcatgggtttatttctgggctctctatcctgtttcattggcctatatatttgttttatgccaggaccatactattttaattgttgtagctttgttatacattttgaaatgaggacctgtggggactgggtgcaatggctcatgcttataatcccagcaactcgggaggctaaggctggaggatcacttgtggccaagagtttgagaccagcctgggcaagatagactccttctttacgaagatatttgaaaagtagccaagcatgatggcacacacctatagtcctagctacttaggagcctgaggtgggaggatcactgaagcccaagagtatgaggctgcagtgagctatgatcatgccactgcactctggcctgggcaacagggtgagatcttctctctcaataaataaataaataagaaatgagaaaatgtgattcttccattttgttcttttttcttaagattgctttggctattcagagtcttttgtggttccatatgaattttaggatctttttttattttagtaaataatgctattgggattttgatatgtactgtattgaattcacagatcacttagggtagtatgggcattttaacaatattaagtcatttaattcgtgaatactgggtctttccatttatttgtgtcttctttaatttccttcatgaacattttgtagttttcagtgcatacattttcaatgccttggttaagcatatcctaagtattttatttcttttgatgttatcataaatgggatttctttcctaattttctcttcagattgtttattgttagtgtatagaaacgcaggtgatttttgtatgttgattttatatccttcaacatctagtaaatttgtttattagttctaacagattttcctgatgtgtggagtctttagggtactctccatataaaataatgtcatctgtaaacacttttttctttcagattgggatgtcttttacttgtttttcttgcctaatttctctggctaggacttctagtgctgtgttaaatacaagtggcaagagtagccatatttgtcttattcctgatcttacaggaaagtttttcagtttttcaccattgaatacgatgttagctgtgggattttcaagtagtctttgttatcatgaagtatatttcctctgttctcatccatttgtgctactataacagaataccacagactgggtaatttataatgaacataaaccttatgggatcacagtactggaggatggaaagttcatgactgaggggctgtctggtgaggtcttatttgttgtgtcataacatgctgtaaggtatcatgttatgatacacatggcacaaagagagaataagtgagaaaaggaggcagaacctgcctgtttataatgaactcaatcctgagataacagcattaatgcatttaaaagggtaaaattctcataacttaaacacctcttaaaggtctcacctcccaattctgtcacaattgcaattaaattgcaacatgagctttggaggggacaaaccttcaagttatagcaacttctatacctagcttttgttttctttttttagtttttaccatgaaaggttgttgaaatttgtcaaatgcttcttctgaatctcttctgatgatcatgtgatttttatccttctcagatcatgtggtgtatcacattattggtctgcatatgttgaaccatccttgcatcctagggacaactcccacttggtcgtagtacatgatcatttaatgggctgttgcattcagtttgctaatattttgatgaagttatttgcatctatgttcatcagggatcttgttctgtagtatgtttttttctgtttaaatatttgttcatttttaattgacaaaaattgtgcttatttatggggtacaaaacaatgttttgatctacataaacattgtagaaattttcagtcacgctaattaacataaccatcacttcacccacttatcatttttttgtggtaagaaagttaaaaagctattcttttagcaattttgaaatatacatttatttttttcatttcctattgtgtgacttttttgacttttattttaagttcaggggtacatgtacaggatgtgcagtcttgttacataggtaaacatgtcataggggtttgttgtacagattatttcatccctgaggtattaatcccagtatgcattggttatttttcctgaccctctccttcctcccacccttcaccctcccataggccccagtgtgtgttgttaccctttatgtgtccatgtgttctcatcatttagctcccacttataagtgagaacatgtggtatttggttttctgttcctgccttagtttactaatgaaaatggcctccagctccattcatgtccctgcaaaggatatgatctcgtttttttttgaatggctgcatagtattatatggtatatatttaccacattatctttatccagtctatcactgatggtcatttgagttgattctatgtctttgccattgtgaatagtgctccaataaacatatgtgtgcatgtgtctttataatagaaaaatgtatttccctttaggtatatacccagtaatgggattgctgggttgaatggcatttctgtctttaggtctttgaggaattgccacacagtcttccattatggttgaattaatttacactcccatcaacagtgtgtaggcattctttttttctccacaccctcgccagcatctgttattttttgactttttcataatagccattctgactggtgtgagatggtatctcattgtggttttgatttgcatttctctaatggtcagtgacattgagctttttttcatatgcttgtttgttgcatgtgtgtcttcttttcagaagtgtctgttcatatcctttgcccactttttaatggggttgtttatttcttgtaaactcatttaagttccttatagattctggatattagacctttgtcagatgcatagtctgcaaaaattttctcccattctgtagactgtctgcttactctgttgatagtttcttttgctgtgcagaagctctttagtttaattagatcccatttgttaatttttgtttttgttgcagttgcttttggtgtcttcatcatgaaatctttgcccatgcctatgtcctgaatggtattgcctaggctgtcttccagggtttttatagttttagattttacatttaagtctttaatccatcttaagatttattcctctactctaaatgaaaaatgtacatcctttgatcaagatttatactttctccacatcgtcttcccccagtcctatggcaaccacctttatatgctgtttctgtaatgttgacttctcacttttttattttttatttatttatttttttattttactttaagttctagggtacatgtgcacaacgtgcaggtttgttacatatgtatacatgtgccatgttggtgtgcggcacccattaactcgtcatttacattaggtatatctcctaatgctatccctcccccctccccccaccccattttacatgtaagtgagatcatgtggtatttgtctttctgtacctggctaattttgcttagcataacgtcctttagtttcattcatgttgggatgaatgacaaaatttgttcttttaaagttttgtatagtagtgcactgtgcatacctatcacattttctttattcattcacctgttgatgggtacaggttgcatgtatgggttagtgcaaaagtaattgcggttttggccattacttttaattgcagcaaaagtaatggtaaaaactgcaattacatttgcaccaacctaatatgtcttggttcttgtaaataatgctgaaatgaacatgggagtgcaggtatacctttgacagaacgattttaattcctctaaaggaattaaatatataccactatatacctagaagtggaattgctgaattatatggtaattgtatttgttttgggaacttccatgctatttttctcaaacagctgtactaatttacattttcactaacaatgtataagggttcctatttctccacatcctcatcaacacttgttatcattcatctttttgataacagccattctaggaggtgtgaggtaatatttcattgggattttaatttgcatttttctgatgattagagatgttgagcattttttaatatatctattggccattcatatctcttcttttgagaaatgtctgttcagattatttgcccattctacaattggtttattgattttctaggtgttgagttgcttgagctttttatgtataatgttggatattagccctttatcagatgtatggtttgcagatattttatttcaatccatgatctctctctccactctgttattgcttcgtttgctgtaaagaacatttttagtttgatctaatccaacttgtctcttattgtcttttgttacctgtgcttttagagtcctagccaagaaatccttgcccagataaatgtcatacagcttttcttttatgttttcttctagtagctttatagtttcatttcttatatttaagtcttttacttgtttggttttataaacatatggtatgagaaagggcccaatttcattcttttgcataaggaatattcagttttcccaacaccatttattgaagagatcgtcctttcccccattgtttattctttgcacctttgctgaaaatcaattgactataaataattgggtttatttctgggctttttatccttttccattagccaatatatctgtgtttatgccaatagcatagctttatattttgaaatgacagagtattgcacctctagctttgttctttttgctcagattgctttggccatttagcatcttttttattttattcaaatgttaggattttttactatttctgtgaaaactgacattagaattttgatagggattgcattgaatctgtagattattttgggtagtatggacattttaacaatattaattcttccaacacatgaacatgaaatatattacaatttatttgtgtcttcctcagtttttttaaatcaacttatagttttcagtgtacagatcttcaactttcctggttaaatttacttcaaagtattttatttatttattttgatgctgttttaaataggattaatttcttaatttctttgttggatacctcattgttaatgtatagaaatgctactgatttttctatgttgattttgcaaactgcaactttactgaatttatgtatcagttttaacagttctcagtagagtgttcagggttttctacatataaagatcatgtcattagcaaacagagataattttatttcttgctttcttacatggatgtattttatttctttttcctgcctaattgctatggatgggatttctagtactatgtcaaaaagaagtggtaatagtcgatatccttgtcttgttcctgatcttagaagaaaagctcccaacttttcagtttttgcataatgttagccgtgggcttgtcatatatggctttattttgttaaggtacattccttccatatctgctttgttgagattttattatgaacatatgctggattttatcaaatgctttgtctgcatctagtaagatgatcatatgatttttgttcttattttgttaatgtagcatatcacatttattgatttatgtatgtttaaccatttttgcatccctcagataaatcccaagtaatcatggtgaatgatgttttaaatgtgctagggaattcagtttgctaatatattgttgtgaatttttggatctatgttcatcaagaatattggcctgcagttttcttttctggtagcatactcttagggttttcatatcagtataatactggcctcataaaatgaatttgacctccttttcaattttttggaagaatttgagaagaattcatattacttctttaaatagaattcaccagtgaccttttccttttttttttttttggttaggagacttaatttattactgatctattttctttatccagtattggtttgttcagatgtaatatttcttgatttagtcttggtaggttgcatgtttctaaagattagttcattccttctaggttattcaatttgatggtgtatggttgttcacattaatagtttatgattccttgtatttatgtgttatcagtgttagtctcccttctttcatttcagatattgtttgagttgtcttttttcccttggttagtctagttaaaggtttttcgattttatcttttcaaaaaaacaactttttagtatttgctttgtttatttctatcattatctttgttattttcttccttctgcaaagtttggggatattctgttcttctttttctaatctctaagatgtaatattaggttgtttatttgagattttccttctttctttaatgtaggcatttattactataaatttttctctcagggcttctttttctacattccatactatttgttatcttgtgtttccattgtcattgatcccaaaatattttctgtttttccgtataatttcttctttgacccattgcctgttcaggagcatgttgtttaatttccacgtaattatgagttgttcaaggttattcttattgacttctagtttcatgtcatcatgaacagaaaacatactcgatatgattttaatcttcttaaatttgttaaaacttgtttggtggcctaacatgtgatctatcctggagagtgtttcatgtgatttgagaagaatatgtattttgttgctgttggatgaactgttctataaatatctgttagatctattggattaaagtgtagttcaagccttcctctaataagaaactgcataaattatgtcaggagcaagccagggaagaagccaccttcctgttcttggtggtagagaccttccacatcttttaaaagaaagattgtggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcatgaacccgggaggcggagcttgcagtgagccgagattgcgccactgcactccagcctgggcgacagagcgagacagcgagactccatctcaaaaaaaaaaaaaaaaaaaaagaaagattgtagagttgggattgtctctggaggaagccagggaagaaggcgtggggaatgttattcctcttgtttaggctgaagaaggtttattcttcatttgctatgtagatttccaagtactggaagaggccagaaccacagggagcggctggaaaacgtgtagcctaatggtttccatggggaagttggaagatggtctgatcccaggaattaaagcttctgagagtgctcaggcagttcaaaaccccccatcgttttttgtacttgagagaaaactccaatggcttatctctgccattcctcaagcatggtgatctaaaagccaagctctgtgtcagggcctataaaagttgggttctacaaaatggaaaaccaaggcaattatgaagatgattttataatatagttcatctcttctctctttacactctagaaaaagcattttctagaaataaatacatttccttaaattaaaaaaaagttgggttctatatgtgtgctatagtttctcaacccttgggaagtagctgcaaatttggttttcttcccaaatgtaaggcactgtgctcagggtggggttagtgcatgagtgtctttccactttttctacccattttgatatgggtattttctgtcctctggtgtgcatgagtttttctactggattctgggtttctctggagagaactgatccatgtgtatgtagatgtttacttggtacgtccatgagagaaaaaatagtcataaacctcctattccacaatgttgctgaagtcacttccttcaaaagctgtaattttcttttcttacagtgtctttgtctggctttgatatgagaataattctggccccataaaatgactttcgaagtgttctttcctcttcaaagttttaagagagtttgagaagaattaatgttgtttcttctttaaatgtttggttggacttctccagagaagccgtctggtcctgtacatttcttttttgggagttactatcattatcattattattattattattattattattattattattggttcaatttgtctattcagttattctatttcctcatgattcagtcttggtaggttgtatatttttggaatttacctattccttctaagttatccaatttgttggtgtataattgttcatggtagtctctttgatccttcttattcccataaaatcagttgtaaattctcctctttcatttctggttttacatatttgagtcctctatcttttttcttagttatgcttgctaaggatttgtctattttatctttcgaaaaaaccaattcttagttttgttgactttttctattgcttttttattctctatttcacttacttagctctaatacttattatttccttccttttgctgatgttgggcttagtttgttctttttctagttcctagacatgtaaatctatattgtttatatgagatatttctttttataatgtagacatgtatctcaataagatttgcttttattactgcttttgctgcatctcataaattttggaaattgtgctttcatttttgtttgtttcaagatacttttaaattttcctattgattttttttctttgacccattgctttttcaagagagtgttgtttaatttccacatatttgtgaatttttcagttttccttctattactgacttccagtttccttccattgtggtcataaaagatatctggtatgatttcaacttcttaacagttgtcaaaacaaacttcatgacctgatatgtgatctatcctgagaatattctgtgcgcacttgaaaagatggtatattaagatgctgttgggtagcatattctgtgtgtttgtgatccatttggtctatagcgttgttcaaatccacagtttgtttatagattccatatctggctgttctgttcattattgcaagtcgggtattgatgtatcctactgttatggtgttgctgcatgtttatcccttcagatctgtcaatgattgctttacgtatttacatgctttgatgatggattcacatatatttataattgttatatcttcttgatgaattaactcttttatcttattttatgacctactttgtctcttgtgacagttttttatttaaaatctattttggctgatataattacagggtgtcctctgtgtctgtgggttttacatctgtagattcagccaatgctgattgaaaacactgtattcatggaatgtgaaatccacagatacagagggtcaaatttttttatccacaggtcctgcaagactgactgtgggacttaagcatcctcaattttggtatcccttggggttctgaaaccatgaccctgtagatactgaaggacgactgtatagccccattgctctcttttggttaccatttctacaaaatgtatcttttttatcaattaactttcaaactatgttttcttaaatctgaaacgagtatctggagacagcatataactggatcttgttttcataaatctatgcagccattgtaggtcttttgattgggaagtttaatccatttgtatttgaaataatcattggtaggtaatgacttactattgcctttttgttaaatttttctgttttgtaattctttttttctgtctttttctctcttaactgtcttcttttgtgattggatgatattttattgtgatatgctatgatttctcttttttatttctgtatttttacgtggattttccttgtggttatcatgaggcaatcacaaatatcttataatagtctactttaagctgataacaacttaacttcaatcatatatcaaaaatcttcacttttaatacctccctcacactttttgttatgtcacaatttacatctttttataatgtgtttctacaaacacatttttgtaattttagttattcttaattattttgacatttaacttttatattagaattataaatgatttatataatactattagagtattacagtattctctatttgtccatgtatttacctttactagtgagatttgtgctttcatatgctcttgtgttgctctttaccatgctttcgtttcaacttgaagaactcactttagcatttcctataagataaatctagtggtgatgaactccctcagcatttgcttgtatgagaaagtttttatccttccttaattttaaaggacagtttttccaggtatattattcttggtcagcagtttttttctttaagtattttgaatatatactttcactttatttgctcttttaaagtttccactgagaaatctgctgttcatcttaagagagctcttttggacatgacaattcagtttttttcttgctgctttcaaacttccctttcacttttggcaatttgatgatattatgtctctagtggagactttctttcttttttttccgagatagagtttcaccgtgttgcccaggctggagtgcagtagcatgatcttggctcactgcaacttccacctcgtgggttcaagcaattctctctgcctcagcctcccgagtagctgggattataggcacccaccaccacacccagctgatttttgtaatttttggtagagatgtggttttgccatgttggccaggctggtcttgaactcctgacctcaggtgatccactcccgctcagcccctcaaagtgctgggattacaggtgtgagccaccatgcccagccgagacttctttagatttgtcctatttgggattctttgagtttcctgaatttagatgttcatatctctccccaaatttgaacatattttagtcatttaaaaaatatttttacacccctttctgtcttctctgtgatttcataatgcatatattgttccacttaatgatgtcccatgaaccttcactcatttttttttttatttcttcttgctccactgactggataattttaaatgatctacctttttttttttttttggtgtccatcttttgagggttttttaattttattttttatttttttatttttattttttattatactttaagttttagggtacatgtgcacaacgtgcaggttagttacatatgtatacatgtgccatgttggtgtgctacacccattaactcatcatttaacattaggtatatctcctaatgttaggtatatccccctcctccccccaccccacaacaggccctggtgtgtgatggtccccttcctgtgtccatgtgttctcattgttcaattcccacctatgagtgagaaagtgcagtgtttggtttttttccttgcgatagtttgctgagaatgatggtttccagcttcatgcatgtccctgcaaaggacttgagctcatccttttttatggctgcatagtattccatggtgtatatgtgccatattttcttaatccagtctatcattgttggacatttggcttggttccaagtctttgctattgtgaatagtgccgcaataaacatacgtgtgcatgcgtctttatagcagcatgatttataatcctttgggtatatacccagtcatgggatggctgggtcaaatggtatttctagttctagatccttgaggaatcgccacacggacttccacagtggttgaactagtttacagtcccaccaacagtgtaaaagtgttcctatttctccacatcctctccagcacctgttgtttcctgactttttaatgatcaccattctaactggtatgagatggtatctcattgcggttttgatttgcatttctctgatggccagtgatgatgagcattttttcatgtgttttttggctgcataaatgtcttcttttgagaagtgtctgttcatatcctttacccagtttttgatggggttgtttttttcttggtttgttgattctttctccagtttgatcaagtctgctattgaatcctctagggagttttttagttcaattattgtattcttcaattccagagtttttactgatatttgactttttgtgtgtgtgtgtatagtttctttcccttcattgatatcctcattgtgttcatgtatcatcttcctgattttgtttagttgtctatctctgttctctggtactttgctaaacttcattaggataattattttgaattcttttttaggcaatttataaatctctatttctttagggtcagtaactgcggatttcttttatccctttttgttgtttccctaattctttgtgttccttgtgctttgcattggtgtctgtgcattggaagaatagccacctgtcagccatccgacacaatgtcacaaaggacacaaaacagccaccaagatttatggactgactttgacagggcaagacctttgccagtcagcctggctagagatactgagagtctctcaaacagctaatctaccgtccccttttcctatgtttgtagctgtatcaattgttctaatcatactggttctttcagtgctccatatgaggcaagagtgaaactggaccctagtgcagcacactgaatggcaaggacatttgatgtgctccactcctctccctcccttgaaagtggtatcttgatgaaaatgaataaattagcccctagaaaggatggataaattgtttcaaaccaagtaacaggataccagcacagttatgattgaaatgcctgtttgatttgaaaacccatatcttttccacaatgcaatgttgccacttactgctttttaacttcaataatttgatcaaagcttatggctctatcaactacccatgcctctttctaataaccaaccctattttactagtttttccaactattcatcatcctcataagtacttttttcacctctaatgatttcatgtgaaattagtttttaataatcataaaacatactactattagaacaaaagtcattaatgagttcaagttataaaaaggaagattacatgatatacaaatatataattacaaatttgagcaactatggagtaaatgttaacaataacctcatttcattaactctcatcttatcaggaagtttaatagcaccaacagtaatagtaactaaaatttaatgaagacttaccatgtgccagatattatgctaagtattcttcatgcattacctcaatttatcttctcagcaaacacaaatgcagtgactactcttataatgatgaggtggttttacttaaagaattaagaaacttacccaaggacaaaagaaaggacttgaacaaagatgatctgacaccagaagtgaagaagtctttattactatgtaatacagcctcaatgtagattgtaacacagaaaaaaactagcctgacttacagaattccttccacctaggttttaaagggatacattttgcacaaggcctaaataagctataggaaaacaaaacacccacgcaagtttctctattgaattaattcataatctcctattagttttatcccattcttcatcatattgacaaccaggatatcattaggggaaaacaaaatctattactttgattttctcttcaaagttggagttttctcctcagtttttctccagcttcttctgtcaagttcttggcatgctgtaattttcagtccccattaatgaacagtaaaggatctgggtttctcttgacattgacatgaagtctgtctctctcatgccttgccagtaggtgagatgaatatgaaaattacataaagactgcatattaaatagaggaaagctgaattaaaacactctaaggtggccggatatggtggctcacgcctgtaatcccagcactttgggaggccaaggctggcagatcacttgaggccaggagttcaaaaccagaccagccaacatggtgaaaccctgtctctactaaaaatacaaaaattagcctgatgtggtggcatgcacctgtaatcccagctacttgggaggctgagacatgagaattacttgaacccaggaggtggaggttgcagtgagccaagatggtggcactgcactccagcctgtgcctcagagcaagactccatcaaaaacaacaacaacaacaacaacaacaacaaaaacactctaaggcagaaagggaagtctggttaccattaggtgtttgatgaataagaaaattcaatataatgggaagcttcccattcaatagcaaacaattaaaaaaataagtaaataagaggaagctgaatattaccaaatccaagagaataaagggaaaccataaccaggtcatctttaattccagcaccctacaagttaagtaatgatctcagaactataaatccttgaaaataaattcttaattatatggattatactaatttatgctgtgacttaaaaaggtgaaattatagactaatgtagaatatacataaatctgtaaaacttacagctaacttaagaaattagcagagaacaaagggagcaactgaagcttctagcccccctttgtaagatttaggcttttccagtcaaaaacctcatttagatgttatgttatttactgttgaattttaaaagttatattttcttttatgtaatcaattggaaagtccttcagtttgggtatgataattgataacttcctcagtacctagaaatctatcaaggataatgttgacatccaataaagtgtttatgttgaaatcctttatttagaattaaaaaggtagtcaaagagtttcttgaaatagagatatagaaatgtatattatcattttagtttatattcattttttatgtaaaggaataatggtatattaaaatgaatataaaattaatacaattttggttattgtatgtagcccctattctttttttattattatactttaagttctagggtacatgtgcaaaacatgcaggtttgttacataggtatacatgtaccatgttggtttgctgcaccaatcaactcatcatttacattaggtatttctcctaagtaatccctcccaaagctcccaaccccctaactgcccctggtgtgtgatgttcccctccctgtgtccatgtgttctcattgttcaactcccacttatgagtgagaacatgcagagtttggttttccgtccttgtgatattttgctgagaatgatggtttccagcttcatgcatgtccctacaaaggacatgaactcatccttttttatggctgcatagtattccatggtgtatatatgccacattttctttatccagtctattattgatggacatttgggttggttccaagtctttgctattgtgaatagtgctgcaataaatatacatatgcatgtgtctttatagtagcatgatttacaatcccttgagtatatacccagtaatgagattgctgggtcaaatggtatttctagttttagattcttgaggaatcatcacactgtcttccacaatggttgaactattttacactctcaccaacagtgtaaaagcgttgctatttctccacatcctctccaacatctgttgtttcctgactttttagtgattgccattctaattggcatgaggtggtatctcattgtggttttgatttgtgtttctctgatgaccagtgatgatgagcattttttcatatgtctgttggctgcataaatgtcttcttttgagaagtacctgttcatatcctttgcccactttttgatggagttgtttgtttttttcttgtaaatttgtttaagttctttgtagattctggatattagcccttttgtcagatggataaattgcaaaaattttctcccattctgtaggttgcctgttcactctgatgatagtttcttttgctttgcagaagctctttagtttaattagatcccatttgtctgttttggcttttgttgccattgcttttggtgttttagtcatgaagtctttgcccatgcctatgtcctgaatgatattgcctagagtttcttctagggtttttatggttttaggtcttacatttaagtctttaatccatcttgagttaatttttgtacaaggtgtaaggaagggatccagtttcaactttctacatatggctagccagttttcccagcatcatttattaaatagggaagcctttccccgttgcttgtttttgtgaggtttgtcaaggatcagatggttgtagatgtgtagtgttatttctgaggcctctgttctgttctgttggtgtatgtatctgttttggtaccagtaccatgctgttttggttactgtagccttgtagtatagtttgaagtcaggtagtgtgacgcctccagctttgttctttttgcttaggattatcttggctatgcaggctcttttttggttccatatgaactttaaagtagtttttttccaattttgtgaagaaagtcagtggtagcttgatggggatagcattgaatttataaattaccttgggcagtaatgccattttcatgatattgagtcttcctatccatgagcatggaatattcttccatttgtttgtgtcctcttttatttcgctgagcagtggtttgtagttctccttgaagaggtccttcacatcccttgtaagttggattcctaggtattttattctctttgtagtaattgtgaatgggagttcactcatgatttggctccctattctttataaaagttctaaatatttgccaaatcatcaaagaagatattcattacttttaattcttacaaattttcttagcaataaaagtcacagtaagacagctagcagataaaaaagataaaagtacatagtttaaaacaacactgattagcacaccaaaagaatattgagccaatccttattatatgtaatacaaatatttatatatgcacatttaactgtgtttggagacccatgtttctacacatatgtaattatttaagatatattttatgtatagctatcatgaacataataaaatacattttatttctatattaacacattttaacctattttagtaatctatagaaagatgtagacaatgattctggttttaactacatttattttttgtttgtttctttaccttggaggtcaagacatctttatgacagaagaacagaagaaatactataatgcaatgaaaaagctggggtccaagaagccacaaaagccaattcctcgaccaggggtaaaaaaatatatatatctttagcatatagattttcaaattatttctaattcatttttaatgcacatctttaatttctggataatacttgaaaagtttactctgcattcgatattattcttatttctttgcagaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtaagaatatttatttttcagattttattttttgagtaaagctaaacttcacttatgctcaaggaagtatatgctgaattcttgaacacaaatttactcttgagtaagtcagtacaatgaaagaatgaaaaaatcctaaaaagcaaaacaaatatctgtctctcatactacagtgtttctgggtttacactacaggccccaaagccaaatatttctatctattagaaggaaattatacttgttgatatttagtttccaatattacctttgcaaaactagttaccatgtttatatatagctgtgtcttggaaaaccaatgttgaatctgaaataacttctggttttagcacatgtgagacttgtcatttgattaatgataatattaatagccagaatatctgtgaatttgtgaaaattcttccagaatttaaagtgaagttaagatctctagaaatgccagttttattttttacagcttaatacttcacaagtgtataaaatgccaatcattcctcaaccagccatggtgttcatgtctgtgaataacagcacatgattttatacttcctatacattcattgccatggttgtttttctatcttcttgtttttgttgttgttgttattttcacatatcttgcaaagtattttaggattgtatttctttttagaattataaacttttaagagagagagattatagagattactacaagtttaatcaacaggttatcaatctgaaaaggttcaaggttgcatgacttagaatcataaaattgagtgccacataacagagtaagcatttaaaatcaataattttggaaaagcatattatcaccagaagtcataccaaaattgatataagaaaatgtattaaaatttaggtgagaatttcacactaacaaaaatgattctgaaagcattcctattaagtcaggaaaaaaaaaagagtgtgcctgtatcatccctgtttttagtgttgttggccaatgcaattagataagaaaacagagaggtacatatataaaaacaatggagtaaatgatccttaatataatgaccttcttcatataatgaaagaacttgttcatatattgaaagagaatcaactaaaaataaattcaattagagttcaaaaggtacaaattttaaattacatgtgccaacactaataattatcttatacatgaaaaaaattagaaaatctgattcacaattgcaataaaaataaagtaaattatctaataataactttatcatatgagacttctgaagaaaactttaggatataaaagaaagctaaaataattgaaaggattgtcatgtacttagataagcttctctcattgtaattaagactttcaaatttattaatctataaattcaaggaaaatatcaatgagtctttttatgtagtgtgggtaataaatagacaaaaacaatataagtctaaatgattctaaattcatctggaagaaaattagggtgacaagaggtggcttattctgcaaaatattaagacatatagatgttaaataaaactgttcaaatataaaagctcagtgggtttgaagagagtccaaattaaactttaatgtataattaccaatttactgtgtgaaaagatcacatgaatcaaaatctaaagttaaaaaaaaagattctagtaggaaatatgtggaaatagacatataaccatatactcttatagtcctttctatgcaaaacacaaatttgtaaagccaaaaaaaaaaatgaagaagaaatgactgcacaaaaaaacaaaatattctttggggaaaaaatcatcataaataaaaggttgaaagacaaaaaataggtgaaatgtttacataacagttaaggccgagaaaggatcaatactttaaatagaaaattgttcttataaattaataagaatatagtaaaaatcccaatagacacatgggcaaataccaaactaagccaaaaacagaagttaaaaacaaccaataaggatacaaaataacaaaacacaaggaaaattgtggattattttcacaaaaaatgcaaataaattacaatagtagatgttttcaaatgtcatgaaaattttttggtaaaaaactataaagaagaatggtagcactcaatactgttgaatgtgtaaagtatgagcactatcatatactgccattagaaatgttaattagtacaggctttctggagataggttcagctatatattgtgtgtatatatatacacatacacacacatactatgtatatagtatagagtatgtatatatgtatactatatatatacatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatagtatatgcatactatatgctatatagcgtatatgcatactatatgctatatagagtatacgcatactatatgctatatatacatactatatagtatacatatactatgtactgtatatacgtatacttagtatatgtatatgtatatgtatagtatatgtatatgtatagtatatgtatactatatactgtatatagtatatatagtatgtgtatatatatagtatgtgtgtatatatagtgtgtgtatatatataaacatatatatactgttgacccaagttctattaacatattattaaaaagtactcatgcaattaggagaacatagctatttagatattcatttcagtaacaaaaatggaaacagtataaatgctagtcttcaatttgtggttattttgagagaacattataccactataataaattatttcgttgtcatttttatgaaactatctccatgacatataaagtaaataaaataggttacaggctgggcactgtggctcacgcctataatcccagcacattgggaggccgaggtgggcgaaatcacttgaagtcagaagtttgagaccagcctggccaacaaggtgaaaaccgtccctaccaaaaacacaaaaattaaccaggtgtggtggcgcatgcctgtagtcccagctactctggaggctgaggctggagaatcatttgatcccgggatgcagagattgcagtaggccaagatcacaccaccgcactccagctttggcgacagagcaagactctgtcttgaaaaataaataaataggttacaaaaaaagcttatataacatgaatacatttgtttgtgtgtgtacatgtgcttgcacagaaaaatgtctgaagtgatactcaaaaaaatattgataatagttattgttgacatttcaggtgatttatattttctttttagcatttaacggtattgcttgaattttctatgtgagtaggtatcattcttaaaatgtaaaacactattatggagggaaaaaatggcccatgaacttagtaaaaaggagaaaatgtcacaatggtaatgttagtcatttctctttggaatttcttaatccttttttaagtaattgcattcagtataaaataactgtcttggccgggcacggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaaaaactgtcttgaattcataagaaatgagttgacagataaaactgtttagagtcatcatttcaggtagcatacatctttaaatattttatttctattattttcctccacatacaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggctattcatttctacaaatgtttttcattcatcttgactcacatgccaacaaggataagacttacctttagagtattgtgtttcatagcctttcttctttcatatccctttttgttcatagaataaccacagaacttgaaaaattattctaagtacatattacactcctcaaaaaaaacaaagataactgagaaaaaagttattgacagaagttctatttgctattatttacatagcctaacatttgactgtgctgcccaaaatactgataatagtctcttaaactcttttgtcaaattttcctgctttcttatgcagtattgtttagtcatcctttcgctgtaagcaaagttgatgaaatccttcctgatatgcagttagttgtttgaccacggtacatacttgagcagataataacttgggcacagtatttattgcatcacttgtatacaatcccgtgtttggcaagctttcaaatcatgtaatatgacagactttacacagatatgtgtttagtatgaataaaaaagcattgaaatagggattcttgccaacttgctctcttgccaccaacttactttcctaaattatggaagtaatcttttttggatatacttcaatgtatacaatgaggaagatgtcaccttctccttaaaattctatgatgtgaaatatattttgcctcaatcaacacagtaccatgggcttctaatttatcaagcacatattcattttgcattagctgtagacatctagttttttgaaaacacctattaatagtaatttgaaaagaaataaccataatgctttttttcgtgagtttatttcaggaatatgagatctttcttctataaagttattcatgcacaggcaaaaattgagctacacaggtagaatgtagttttacttagaagatttttgtgggaggttttgaagcaaatatataaaacaactttcactaatttgctttccatatttaaaaaataataaattacatttatataataaatgtttaaagcacatattttttgttgttctggcaatttaaaaagaaagaggatttaaacgtacctatagaaacaaagatttatggttaaagaatgagatcagaagtctagaatgtttttaaattgtgatatattttacaacatccgttattactttgagacatttgtcctaatctacgtataaaactcaatctagggctaaagattctttataccatcttaggttcattcatcttaggctatttgaaccactttttaatttaatatgaaagacaccatgcagtgttttccgagactacatagatcattttatcacatacctaccaagcctgttggaaataggttttgataatttaagtagggacctatacaaaatatattacatttatcagatttttaaatacattcaattaagaatttaacatcaccttaaatttgaattcaatctaccgttatttcaaactcacaaatataactgcattatgaatacttacataatgtagtaagacaagatgtttgacaggttcgtgtgtaattttctattaatgtttttacattgccttgtttttatgtaaaataaaaaatatgggcaactggtttgttaacaacacaatttcttcttagcatttcaaaaatatatataaagttgttctttttcctatttcatgaactatgtttttttttaaaataacatggttaagttttatatatatttacgtttgtttcaggaatgtctacttgtgactttttatcaattaaaaataatatttggaagaaagagcttattaagtataagcttgaagtaaaattagacctctctttccatgtagattactgtttgtactgatggtttcacccttcagaaggcactgtcatattaatatttaaattttataatcgctgaacttattacacccaacaatacagaaaggcagttacactgaagaacttaacttagaataaaatggaagcaaacaggttttctaaaaacttttttaagtgaccaggtctcgctctgtcacccaggctagagtgcaatggcatgatcatagctctctgcagcctcaactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatctttcggatgaaaattagagaacctaattttagctttttgatagttacctagtttgcaaaagatttgggtgacttgtgagctgtttttaaatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttatacaaaataaaa

SEQ ID NO: 5304 - DNA, 190794 bp, Homo sapiens
taggataaatccagagcaacgttagttaaagttaattcagccccactgctaagataagacccttctgcagagtctacccaatatctcctgtgttttgaggtcttttcactttgactggggaggataaaatattactatccctgtgtgaggtccaagaatttttaacctgctacttaagattacagtcatgtcagtcatgtgccagataacacttcagtcaaggacagactgcatatatgatggtggtcccacagattataatactgtatttttactgtaacttttctatgtttaggtatgattagacacaaaaataccactgtgttacaattgtctcagtacagtaacatgttgtacaggtttatagcctagaagcaataggctataccataaagactaagtatgtagtagactataccatctaggtttgtgtaagtactgtctctatgatgttaaaattgcctagtgacacatttctcggtacatatctccattgttaggcaatgcatgactgtagttctttctctggcttagggtatttttgttttcacacaattgcagaatgctgtcaagcaaaaacttgaggtctctttctacagatctctggtatactctctgttcagctcccttgtcttaggtgtcctgtcccaaataaacaaattctagctccctcagcctatcaaactcttattttctggctcttcatgtttccatcttcctgagctgtggtttagaaactttgtgtagtatgcagagacaatcacagcctcactttctttctcttctctagggatcactgtcttatagataatgttgcccaatgactgaaaactagtgtttcatatattttgtccccttatctaatggaagacttctacaagggaatgtcgataacaatagttttgatcaaaaataactccacagaaagcacattatcagcaaaaccattgttagggtaagggacccatcagtggactatgacactggggaaaattcttcaggaataagtaatcaattaatatacttactaagcatctactacatgcaagacaaaacatttatttttcttcacatcagttttctggccaaaaaaatccagaccacgtcaaattagacgagcaaacactcagatgccaatacatttaggaaacctcttttcttcagttgtttcattaagcatcatttgcccatctcatcactccaatctatgtctgataatcttcattgtatattctatttctttttagttataatttgaagttctacttttgaatcctactttttagctatgtatacacaaaacttgtaactttattcttctattttcacaacagaataattgttttttcttactttgtaatattgccgtgcagccaatattagaaggtaaaagtatttttctaatcctatttaattagagaaaaacaaactctttcagtattgtattaattttattgccttaatattactgtctattttttgttcttccagaaacttctacagttttgaaaattgcagtggcaattgtggaaaatacagaagtgtggatatccatttatttctcactaagggaaataaaattcttattcctattctggtatggattgtatgatgttagttaatttccatgactcaacatttccacatttttctatctaagttacggaaggtcagttgtaaatatgattaggaacttattggttattggctttttcaaccagacaggctttgtctggttcccttaattcaagcctaccctttaaattttaaacgtaccatctacttatgtctacatctgacgctgtcatttagtgtttaatgaactctcaaggctgtgcagtgtagtatttaataagaaatttggaaagatactttttctgggtttaaaccaagataaaatttctagggctgccaaaagagcaagaaaaacacaaacagctaatgttctgtagactaggaatggcacataaaagaaatggaaaggaaataaatagttggaacatgaaagaaaattgggaaaataatgaataatatacctaatgctttgcctatgagctcacagggaaaatcctgcaagggatccctcagtcagaccaagaggattttatttttggttttatcattttccaggattttatgtttgaagatctctaacaagaacctagatatattgagaatagtaagttcttgttaatggatgcttaaagtggaatatataatatgttatatattatatacaacatatgtattatacataacatatattataacataatatagtaatataatatataacatgttataatatataggttatatataatgtataatgcattatatattccactctaagaatgtatctaacatatgtgttattctagatataacagcaaaggcataatctataagagacataattgctaaggtgaactgcattaaaattaaaaacttctgctctgcaaaaacggacaacaagccagtgttagataaatatttgcaaaagacacatctgacaaatgactgttaaccaaaatatacaaataaagcttaaaactcaacaacaagaaaagaaataacccaatgaaaaaaatgggccatataccttaacagaccaaagaagatgcacatattgcaaataagcatataaaaaggtgatccacatcatatatcacaggggaaatgcaaatcaaataacacttatggtatcaacaatgggcatgagataccaccacatatgtattggaataaccaaaatccagaacactgatgatatcaagttctggccaaggatgtgaggcaacaggaactctcatgtattgctggtgggaatgcaaaatgctccagccactttgaggacagtgtagcagtttctttaaaaactaaacatactctcaccatatgatccagcaattgtgctccttgatgttcacccaaaggacttgaaaacatgtccacacagtaaccttcacaaagatgtttatagaggctttacgcataattgctaaaacttggaagcaaacaagatgtccttcagtaggtgaatgaataaactatggtaccaccagtcaatggaatattattcagcactgtaaagaaatgagctatcaagctatgaaaagccatggaggaaaactaaaagcatattgctaagtgaaaggagtcaatctgaaagggctatattctgtattattgcaactataggatatcctggagaaggcaaaactataaagacagtaaaatgatcagtacttgccaggggttgaaatgggagatgaataagtggaacacagagaattcaggagagaactgaaattactctgtaagatactgtaatggtggatacatgtcattatatatttgcctaaccccatagaatggacaacaccatgagctaaccctaaatgtgaactacagaccttgggagataatgaaacctcaaagtaagttcattaattttaacaaatgtttcattctggtggggaatgttgataatgggggaggctattcttgtgtgggagtagcggttatgtgggaaatctctgtaccctcccttcagttttgctgtgaacctaaaattgctctaaaaataaaattttaaaaataaaagaatgtggcattgcttgcatctaataaaaaagaccattattcctattgcagttgaactcttcttcctatatctaccaccaatcagggaagagaaggcgatttgtccaggatatggcactgagaattatcacaagtgagctagttcaccttcattgcacagtctcagtcactgaagtttccttccttcaatagcacatcttacaagtcaagaatgtaaggtccaaagccccaggacaaatctcagaagcaaagaaagcagcagggaaaagtagaccctgggatttgatttccttccggttatctctaagcatcatttccatgatagaaggtgtggaagcaaataataaaagtgcccgtcactagtgtttatcctgcaaagtggtctgcccttttgagaggcaccctgccctatggccatcctttgatttcttcccttggtggaaatttcctgtttctctttgagaaagataattcaaccctgtttccattgttcttcctcccaggctgctgtaggaaagcgcacgcacacactccacacaaaatgaatttttaaaaaatttattttcacagtcgctcctaccagctctgaaattcagaacccatatgactgatggcatattcagataatcgggtcccaggtctggaaaagcagccttttccccacgtttctttccccacctaggacctcctctgattcttcactgcatcttcgaaagaaaatgtattatttgcttgcctggaagacgctgcaattcaattgattttatatatacatatatataaagaaaacagaaaacatagcctagataccggtcttgagcgtcaccgccccactcgcggttgtgagcaaagccctacggaagaaaccaattcccagcctagactcttcagagcccaaggtcggggaggcgctggcctggcggtgttgtctggctccccagccactgccccagactcagggctttgccattggtccccacctcctctgctccggagtttttctccagctccccaccaagccacacaaagtgacttctcggaaacattagccgattctgctgagcaggaagggaggaaagggatgatgggggcgggggtgagataagggaagggctcttctggctgctggacacacacacacacacactcaaacacacacacgccccacccaatgggtggccgtggatggcaggtcgtgcaaccccctcctccgccttctattagcgcatggtgcagaggctacagcgtcgccaccaccgcgcccctagctgggtccccgccctgcgccgcccgcaggagtggagagagggagggagggagggagcaaggggtggggacccgggcgcgctgggaggagtggaggaggcaaagcggcgcagctgccctcggggaggcggggctgctacctccacgggcgcgccctggcaggaggggcgcagtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagtaagtgccttttcttttgctgcttctgtggggaggggaggagaagccctcggtctttcgcccgtgctcgcctcaaccgccacacccacctgtgtctattttcacatctcggttctggaaccctgtattacgccacctggaaagaagagaggggagaagcttgaccgggtggttccagcaatgggaggaagaagggctggaagcgtagttatttcgatagctgggcagctcctgtgcggttttgactctgtgggtttgctgccaggttctgaaactgtggaaaggaagggtagcaatgcctggtggtttactgtcttttatttctgtttacgctagcagagttgttagatggacttcaattcaaggggcagctcacattttttacgagcaaaaagcatgtgctgtatttcccatctgcaaagctgagcgtgcagaaccagcttagcagatacaacctgtggggacagaaaagaaccccgcaccccttaagagcacacaaacacaaataattgacaggacagctctgcccctatttctcagcgcagattatttatttattttttcgaataagcactttatagtgaaattcagaaaagatgcagaatccttttaactttttatcgaattcaacttgggaaactcatttacttttaggaaaaaatggatattttcgtgccttatattcaagacaaaaatcagaacaagaaactagaaacattaatgccagtttttgtgattatagtaaacatttcactcattattttagttttttttttttaagttggagcgttcatagattatatctactctgatgttaagagcaatttacatgagaaacttaggggggtttttaagaagctagtgtcagtaagataaaagccaaatcaaagtaagctttcaaggaagtgatagcttgtcagttactgaataggaagtcagtgttgggaagttcagttcttttcagaaacatatttattattcttttctatttcttcttccctgtagacaagataaagattttctttctctttctttccttgttatttaaatatattttataatttttgctttaacatcaatataaacctattttatataaactgcaaaccaaatccaattattaaactgttcattttattgcaaattcttcagattttttccactatttaaaaaagtttataattttttcttataattatggtgagattttttaaaaattattgattagtttgaaagctagtcttatctgatccctgtgtcgcaaattttcatgattgttagactagcttatcaacaacaaaactctagacagaatatggtatttgatgtaaagaagaatgtgccctctatttaggcaactgatagtttggcttaagacaagttttttaaaattttgtagaggtttaaaaggaggtttccttaagtaagccactgtgcagttgtgggactcagtgatgtgtttttacagtgactggatatatgatatgccttgattcctatggtgcagggctaggctcacagagtacctgatgcttctacagaagaaagatgagtcaggtctggctctctgccaaaagcatcttgggcctcctttcccctagggcctgcatataatcatgggagcccttctgtggtaatgcttctatgtttttactacctgttgctgtgctgagtttcagaagcaaaatagataaacaaataaataaattcagaagagcaatcagtagggttctatttatttaatataatcaacccactttctctgtggcaaggaaaaaagtagaatttttcattttacatgaataataaaatctattttttatccaatttctattcctattagttatgcaaaagagtgtgaagtgctagaaggatttatatggtacttttctaagacaagtcatgatcttgtaaaagagcttaaagtttattgatgtaaatggaacattctagatgtcataatgataataatttatgactttccctaaaactctgtctcagattctttcctcccatcttcattatctgaataaatgccttcaccatccaagtattgaaatcacctttgattgctctcttccttattactccatttcagccctttccagcctgtaagtagatctatcaatcttatctcccaaacttatttctatttcatcatacgtctcagatgcctctcattcaccctcttttctgtatctacacggccaccaaattagttcaggtcatcatcataatttacttggaatcctgccacagcctccatatcaatctctccacttctgtaattttctcccctgcaattcattctctatacaaagcaataccatcctgtctcccctaacaaacattggctcacaactgcatttaaaaaaaaaaaaaaagaggaagaagaagaggagaagaagaaataaacatggcaacacagagaccaattagcaacaacagtaaatgcctttcctcagcatatggtttactctctgttctgtcccttctctccaacctcaccagaacctattctcttctcattaaggtgctcctgcccaggtcgtggctaaaacacatgaaacaatagcactctttaaggccttttcaaatgctgttcccaatgcctgaactctatgcgtgcttactccttcttaaactttaaatctcaactcgaggtttttttgttttggaaagatcatttttgatcatcttgttaaaagtaggttgtcccgtgttggtcttgatgttggaaccttgtttctttcatactgcttgttacagcatgcaggtattttgtgaatttgcataccaaatactccaagggaacccagactatgtcttcattgttgacttagcttccagaatagtgcctggcatcaagtagtagggggttcgtagatatttatataaataataaaatacaaaaatatggattcttccagaataaagcatattaaccctggaaacatgaattttgtgattctattttttatttgtcaagcatttagtatttttacaatatcatggtatgatattgaggaggtaaaattaaaatatcctgagatgtattctctcttttatcagtgtaggtgataatgtacttaaaggtaagtaatttgtaatgcattcttagaaaggcagtgaccacaaatgtattaaaatatattttaagaaaaaattggattgcataaactaatatggttataagtgactccaaatctaaaatgataaccttgttaggtttaaatctgtatcatctaacagaaatttgagggccagtcaatagtcactgactatgaatttaaaatattcttttaaaataaacatagatgcttatgtgagctcagttgatagaaatgtagtcagatgaggcggaggccataagttaggtttccacacggtctaaattgatgtttgccccaggtacaaagggcacattatccaaatatttgaagcattctctaaggaaggttcagagaggcaatgtgggcttatccatgaagacccatcactgttattagagtggaagtaaggactgcaaacttcatgctcataaatgattgtgtcattttcatactagaattttaccacacacacactcacactcacacacacacacacacacactttgtatggtgatttgcctcccccctttatttttgcagactatgcttaaagatattaaacaaacaactagttttgctattaacatttggttgaaaatttagctttcaattaggtgacaaactgattaatgatttttttatgtagcaaatggccagccacagatttttggtaaataatttggttaccacattacatcttgaaggactaaattatttcactaattgtgagcagggatttttaaaaatttgctctgaagaggacatattgtggatgttgtattggagggcatctgtgtactaattgaagatggtccttcatattacacatcacaaattagctaatttattctttacagaagtattatgacatcttcctttagaactgtgtagagttagattaccacttgagaggcaaggtcatattaaaatagatattataaaattgtataaaaatattttatatgaggatttatgagagcatccagagaatgtgggtagaatacttttgtggaatatgagataacaattttggtgtcctgccattctaaaaaatgaaatttcttcattgaaggtatcacttaccctttcctctgccttgctggaaggaaatggctttaggcaaaagaaaaagccatcagctcttggcagctaaaggtggaatgaagtttggaggaatgaaacccttctgggtggtgaggaaaaatgccaggccatgataaagtggggaaggaagaggggaatgccttgaacagtgccagtaagcataatctgccacagacaagtttgaattgacatatgtagaactgaattattctatatctttttagttctatagagaaaaccgttctttccacgtctctttttaaaataacaacttactgtaagcaaaaaatatgttgttgttgtttctttaacacaggagatgaactatctttagattttttaaagtgatataacatggagccaaaaatgccatatattactgttgaaacctaacgttactttaactgtaatttccttgctattcattttatgatttcctcttgttatgtcaagtgttagagagactgctattactgatcataaatttctttaaaatgtctccttggattttttacaaagctttctgaatcatttatcaaaatacaataaagctctaattgcacctaggattgttcacttggaaatttagaaagagtgtgtacatttacaattaagttagcatcctgccctgcaatgaatgccctttttctttttttttttccttcttctctcctacatctcatcttccaaatgtttgatatgtacgccagtaaggcaaattttactccacttttaggtcaaactattagtacaaataattggaaaattgagcctctaaagaaagataaataagattagaagcatgcattaaaatataagtattaaaaacattcccataagatttttaataaaaattttatgtgctatatgcacacctagactccctgtattatctgatttttaaagattcttttttttttttattttttatttttttgagacggagtctcgctctgtcgcccaggctggagtgcagtggcgcgatcttggctcactgcaagctccgcgtcctgggttcacaccattctcctgcctcagcctccgagtagctgggactacaggcgcctaccaccgtgcccggctaatgtttttgtatttttagtagagacggagtttcaccatgttagccaggatggtctcaatctcctgacctagtgatccgcccgcctcgacctcccaaagtgctgggattacaagcatgagccaccgcgctcagcccattatctaatgatgatgatgatgattattattattattattattattattattattattattattattttaactgggggtaatttcactggatgtggtatctgtcaacttttactagttgctcctacactatatgtttttaaatccaatgtaattattttaaaaatatgtcatcttcttgagagtctatactttagaatttgaaaaaagaagtaaatgtagatattcaaatccatgcagatgagtaaaacagggaaaaatgagaaaaatgtttcatgataataaaatattatgtcaggcacagctggtcacccctgcaatcccatcactttgggaggccgaggctggaggattgcttgatccaggagttctagatcagcctgggcaataaaaggaaaatctgtttctacaaaaaaattaaaatttatatttcatatattgatttaagctctactaaatgactattctttcaagtctaatagacagtgtatcttttagggctcagagtaaagataatttattgaggacattttgaataggatgaattaaatgctttattggtaagtgatgcctttatctgagtgattccttctaggtaaatattatgggaccaatctttgtaaatgatctttgcatggaacaaaatattataaagttgaagtgatgaatttgtttccctcttaacaaaatatgtattcttgttaccccatttacaaacttggctcatggtaattcaggtaggaaaaagggaagtggcctactcagggatcaactgggaataaggttcttataatcccatgagatcagctgacagacttttaggaatgaacacttgtagaacagctaggcagagaagtgcctttcaaaatttatattacatctctactatatttcagactgtaaaatatttttataaagtgttaaaagcacagataaataaatttgagttcaaattagtatagtgaaaggaagtttatttttcccaaatatttcctttactcagtatgtggtcttagtcaaatattaatttcttaaatattgctttcctgtaaattagtagtatttacttctaaggactatattatatgttatatatagagtatattatatattaggagatatatatgtatatacatcgtaatttgttttttccaaaacagccactttagtgtcttacacatgataagtagatatgagtagatgttcaataatggtatctaggcatttaataacttagaatattataatcaaaatgcattcttttttttttttttgagaccgagtttcactcttgttgcccaggctggagtgcaatggtacgatcttggctcactgcaacttccgcctcccaggttcaagcaattctcctgcctcagcctcccgagtagccgggattacaggcatgagccacctcgcctggctaattttgtatttttagtagagataggatttcaccaggttgggcaggctggtcttgaactcctgagttcaggtgatctgcccgcctaggccccccaaagtgctgggattataggcgtgagccaccatgcccagcctctttttttttttttttttaattaagtttcaaggtacatttgcaggatgtgcaggttttttacataggtaaaggtgtgccggtttcactctgttgcccaggctggagtgcagtggtacgatgttggctcgctgcaacctctgcctcccagattcaagtgattctcctgcctcagcctcccaagtagctgggattacaggcatgtaccaccatgcccggctaattttgcagttttagtagagatggggtttcaccatgttggccagactagtctcgaattcctgacctcaggtgatctgcccacctcggccttctaaagtgttgggattacaggtgtaagccactgtgcaaggccagcaattatgctgttacaaggaaaaatacatacggaaaagtttacatcttgctaacattactgataatattaatgtaacagtcttatgtatggacgtctccttaatgctaactgagcagtttgttaagggattttcatatgctccgtttaaatcctcatgaccaccatttgaggtgagaacactaaggctcagaaattacctaacctttccaaagactcacaatggttactaaacttgaataacatacacatttcttttataggaaagaaatcttatatattccaagaatacgtttgcacataccccacacagatatacctggtggttacgctaccaagcattctatcaaatatgtttaacccttaatggagctaaaataaaattacatttgcaatcaaacatactaaatcatgtaattacagctaatagaaaacaacaaaaaaagaaagatggatgactgtttcaattttcttcttggacaccaattcctgaggggtatattgtgttaagtcaaaatagagattttggtggaagtttgaagacattatgaaaagagtacctatgcatttaaagtgtttttgaagttgttttataggttgaatgacttcactttcctggtctaggagtattattgcactactgtgacttgactttgctatgattcgcatattttgttttaacattaaaaaactgaaatgggaaaaaggccttccccaaggtagaaaagatttgaaaaaagaggaatggtgtaattaaaagggaaatatgtataaaatgtctagggtgggccaggcgcggtggcttacgcccgtaatccagcactttggaaggctgaggcaggctgatcacttgaggtcaggagttggagaccagcctggtcaacatagtgaaaccccatctctactaaaaaaaatacaaaaactatccaggcatggtggccagcacctgtagtcccagcttctcgggaggctgaggcaggagaattgcctgaacctgggagatggaggttgcagtgagctgagatcgagccactgcactcctgcctgggcaacagagcgagactcagtctcaagaaaaaaaattaaaaaaatgtctaggatgaagtttattctgaaatggagaagaaacagggaatgaagttacacacgttgagatcctggagctagcagatggagaagtatgaaaagcaaagtgatcttgtgcaggataagatgatggtgttcattggaagtatttatatatcttggaaaataaaaatttagatattctatattggaggagtacaaatatttagagcatcacaaattgatacacacaaatgaaacctaaatcacagtacttattgtcatgaagactcaattatctaagtcagttaaattgtctaacatcagtaatgcaagaagttgacttttaagggttttaaaacagttttggaaaactaatttattttacattatgtttataataatttttgcatgcaatttttttaaatatctattatccacttagatactgtactttgggatataaaaaccatgggaaatttggcccttgagttctatgatacgtctcaatctattttagtgatttgtggattggtagcttatcctctagactaagtggttaaggttttatcagcactgcaatgagataatcatctcacacctgttaagatggctgttataaaaaagtgaaaggtgttgttgagaatgtgaagaaaatgaaagcattgtccactgttggtgggaatgtataatagtgtagctgctatggaaaataatatggaagttcctcaaaaaattaaaaatagaactaccatatgatccagcaattgaaatcagaatctcaaagagatatatgcacttctgtgtttactgcagcattattcacaatagcaaaaatatgaaaacaacccaaatgatcatcaacagataaaagagtaaagaaaatgtggtctgtatataaaatagaatattatctagccttaaaaaaagaaggaaatcttactatttgtgacagcatgcatggacctagaagagacatgctaagtgaaataagtaaagggacacgaaaacttttgacagtgacagatatgcttaacaggtagactggcagataagaaaaaacaaagttaaagctgaaatttccaactgatttatcttagcctagggattaatcattagatccggtctagttggcctccaaaatgtgtaggtcaggagttggcatccaagttggtattggtgccattgaggtttgtagggagggaagacctggcagagatcccaagggcagtggtaagcggctgctgagtccctccaggccagttccaagaactcacaacctcactcctctcagcatttatactcttcctggaatttaaaagcaattccttctttccttccctctttcttttttccctctcttccttcttcataaagttttattgtagacatcagatatagcaatgaacaacacatggagatgtgacgccgattttaagagataatgaagagataaatattcgccactatccatcattgtaccataagatatgctgtgaaaaacaataaaacaggacagagaattgagagaaggaggtattatttaaagtggtctgaaaaattttatacagggtatttgagtagagacatgaagtaaatgaaaaactaagggagctagctaaacaactgaagaatcattctagtcacaaaaaacagcaattgcaaaagccctaaggcatatttgatgtatttaaggagaagcaagaaaaccagcatggttgaaatacagacagcaagattgaaagcagaagatgagggtttttcttgattttgtagggattactaacctgcgtcgagggctgcgtgataaaccaatgctaaaattaccagcatgggtacaactttggaaagggatgagtgtgctcttttttaactggatctctttctggacatgggtaacataaaaccagaaaaaaatgtttgagaagtttctaatttctatacaaaaataatgtttttgtctttttttgtgatttagatgtaaatgtatatgtacatgcatgtatatgtatttatgtactgatttactatttatgtatatgtaaatgtatttatatttaaatgtcctatattctcttcctgtctgtaatggattggattcttggaacctcttactatttggggcagggggcagggctaataagacaaagattacaattgagagtaactttaaatgtttgcattttggaaacttaatggtgggagtacagtaatattttgtatatttcgatcaattttgatgtttattatatgattatttctcatgaaatagtggtactgcatagatataaatgactactgcctagcaaaacagataccaaggagacaccgcatgttgtcagggttgaccggttgctaactgctgtgattttgttctcttactgactctttctgccttacggatctcaaaacacgctagtgaatttaaaaatttatattttggtaaaatatatataacaaaatttaccattttaaccatttcaaatgtacagtttagaggtattaagcacattcatgttgtacacgatcaccaccatccatcttcagaacattttcatcattccaaacaaaaactcggtaactattaaacaatgactccacactcctctcttcccctatcacccagtaaccactattctactttctctatgaatgtgactattctaggtacctcatgtaagtggaaccctatagcatttgtcttttcatgtctggcttatttcacttagcataatgttttcaaggtgttcatccgggtcgtagcatatatcagaattttattcatttttaaggctgtgtagtattttattgtgcatttatacacattttgtttatctgttcatctgttgatagacatttgggttgttttcactttttggctactgtgattagtgctgctatgaacattggtgtacagataactacatgcgtcccttctattaattgtttaggatgtataccctaaagtagaattgctggatcatgtgatatttctgtttaattttttgaggaaccaccacagtgttttccacagcagctgcactattttatattcctatcagcaatgcacaagggttacaatttctccacacccttgtcaatgtttcttttccttttttttttttaaacaataaccatccgaccaagtgtgaagtgatattttattgtggttttgatttgcatttcccaaatgatcggtgatgttgagcatcttcccatgtactgattgactttctttggaaaaatgtcttttcaaatcctttgttcatttttaatctgcttgtttattttttgttgaggagtaggaattttttacatattgccaatgttaatcccttatcagatatatgatttgcaattattttctcccatcatatggattgccttttcactttctagtagtgttctttgatgcacaacagtttcaattttgacaaaatccaattcagctctttttttcttttgttgaccgtgcttttggttccatgtccatgtgccaaatctaatgtctcgaagatttttccctatgatattttcttagaaatttacagttctaactctgacgtttaggtctgtgattcattggtgattttttaaaaattcctatataattcgtagactctaagagagtttccagctttcccatacccattgtccccagagatctggtttttagtctgaatgtgccttactctgaacatgtgccttccatttcaagaactcccatttcattttgttttgttctgttttttcttttataccagtattaaaacttttgagttgttgtataaatatactagcaatttaggagaattcctgatgggaaagaatatccttgcctagctagttaatgaatttagggacccttcattttctaatcctagatatgattaaatcaaacaaggattcattgtgctgtagttgtaatccacacagaccattttacaaggctttgcacagagaaggtgcttaatacttgagtaaacaaattgaattaatgagtaagaaagaaaagctatcttgttttctcaacggtcaagtagatcaatgatttctactatttagaatcttagatttattttaataaagcaagttcaaaaatctcctctctctgttaatttttagtaaagtcacttatttttcactcagttttgttaaagtgttttcagaagagtttgttaccgaaaactgaagttttaaggttagtgtttataccacagatatttcttgtttttagacaatccttgtggaggttaagtcccctaggcaataccttttcccactggggagttacaagcaaatgaaaaatggtgactatttatggaaactccaggtcactaagtaaattttgcattttcatgaaaatatgacatatggacatttaaaaaaatgaacaggtcaattcatcagttagaataataaaaagaagtctgtaaataaaagttaagcacctttgtcattgaattgttgtgaaccgtttttgcctatgcacttgctttatctcagaatccaagcctcctggtcaaagttatattcctaataaatttaaaaataataatttaataattttaattccttctggaatataaatttgatcaggagtcttggattctgagataaagcaaatgtttaggcaaaacacttccttctggaatataaatttgaggaaggataggaattattttcttcctattcatttgtgatcctgtgattgttatctaatttggaatattcttcatgactccaatcctatttatatctgtgaggttctgaaaattctgccccaaaatggcagaaagtaagaaatactatcacacatttaattcacccttaaaaaaatagccataccctttatctttgaatatatttttaacaacaacaacagaaagagaatgcattttaaacaatatcacatgagtttcatcatattcccagattatggtgagggttcctagataccttgccataatcacagcctttagttccaagagagagcagagaaataagaaacacaggaagtcatatctatgaacatgttagtttgcaaaaggtttgttagtaaactcatgttatttataccatagtactttaccatctccagatgaatttccactaaataaactgttcctttagactcctcaaaccagattacccccttcctttgctaatatagattctcaaacaatgtcttcatcaaaaatcttatgagtagatgtcactagttttgacaatgtccacaaatgttccaaagaatactttggcatgcatgcttcttaactcacttattttgatattgaattaaagggcttttaacaattcctgccccatcaggaatatttcatcagcagctgttactgtgcttggattttgccttcttgaatgaatacctagtcttttctcactttagcattaagttctggagcatccgctgctaatgaaaaatcctctgactcatgctagagcattttcatttttttaaaaaaacaatgttccttgtatcttgctggctattgcctaagctcattattttaaacttttgcataattctgctcagtcctagagggtcatcattactgtcaatgattaaacttttatgcacttgccacatttattattttcttactttcgatcattttattatttttctttggttcccatgatattccaatgtttttgttattaaatctttcaacatcctcggtgtgttcagtgtatccacatttatcaaacctgatggatttaagaatttatataaccttgaaagcaaggcccacatcctgtagacactgaataaactaatgaactttgtattggcaggactaaaatggctgtgtgtggcatatattgccacctgttggtagaaggcaatgtagtcttggttttgctataagcatacattttagtctttaaaatattctgagttgaaagctccctaagaagaaaaggttttgtatatgcaatacaaaagcttttctattataaagtaagcaaatatattctcgttcctaagaacattagctttaggtatacaaaatcaacttagaagaaagttgctaaaatcactaataataacagttacaatgtattgtgcactgaaagtgtaacaggaaatgtgctaagttattaaaattcagtgtctaattttttccactaaaataaccttaaaggattatcattttcagctccggtttgctatataagaactgagctttagagaagttaattaaattccccaaggacataagctagtaagcagtagagatgggatgtgaacccatgcctctctcactctggagccatgaatttaacaactgggttatgctgtcttactattttactgcagatctatattttaaattaaagccataaacatgtttggcaagataaaacataggtaacaaatatactccacataagattttcgtaaggttttgtgtttattggccaactcatggcttattatttaaaaatttcagtctgtatagggaagaaggataataatcttgctgttatttatttagcctaggcactgtggtaggcactttaccaaaaccatttctattctacatgataactttataagacagatatatttctctctttcatttatggggaatttgcataatgctgcagagctaattatatggaataaacaggaaattcaaacctaagtctgcctggtgccaaagttattactatgcactttctcctaaatcatgttgatgttttgagggaagtggatacatgtataataatattggaaatacattttctctctaattatttaaataagggtatagaacctgttctgcagccataagtctgtgataattttgtgctctcaataaagtcttaactaacagagagatgggatttaacgtgaactaagaagtattttctgtcttcctttatacatgctgtacagataagactttatgaattttttattaaaacgttcagatatgccagcaaatgttgacactaatcttaagttttcccagggtaatacacttcttaagattataaactttaatttctttttttttttttcttttttttttttttttgagacagagtttcgctcttgttgcccaggctggagtgcaatggcccgatctcagctcactacaatccacctcccgggttcaagcagttctcctgcctcagcctcctgagtagctgggattacaggcatgcgccaccatgaccagctaattttgtatttttagtagagacggggtttctccatgttggtcaggctggtcttgaattcctgacctcaggtgatccgcctgcctcggcttcccaaagtgctgggattataggcgtgagccaccacgcccggcaaactttcatttcttataaacttgaggaatactatattttaaaaggctatacataagactaacttctatcttaataataaaataataaatataatataaatgattattacagggtattatgaaatacccaaatcacaatattttaataatcatagaatttagaaatagtccctatcagttgtctgaatataaaattatcgcatatacagcttaatttgttttgcataccagttgttcaactactataaaatgccataaaattgaatgattttaggacatgaaatattgaactactcttgttgaagttattaaactgatttgccatctaccaaattaagcatttctaagaaataataattattttaagaatttatttacatgattaacataatgttacttatgaaggatgcaatggtaagatttcagcaatcaggcaagtatttaatgaaaagtatttggtttcatatatattgtatttgatttcatatatattgatacacttaacattagaggttctaaaatgagtagccagcctgcctgtttttcttgtgatattatacttggcatactttgtttttataatctaaagaagaggtattaaaaaaagagtcagagtgcttaccattggcagttccttttaaccttttaatttataaagacattgcaatcccaatgaaaataaaaatagaaattttcccatttggaattagataatctggatctagttgggaaattgtacacacataaaagagtaatatctaatagcaccaaccctaatacataatgttattttatgcaaatagggtaattaaaatagtatggtgacctacatagatagttcattggaagaaaatacgatatccagaaatagacatagttacatatgagaattataaaggtagcatcttaaataggttgaaagaaatattatttaatagttatcattgggacacctgggtagtcatgtggataaaaataaattcagattactgctttgccacctaacccaagatacattttagtggaatcaaatatttaaaataacatacaaaccacaaaactgctagaagaaaacatgtgaaggttttgttttcttttttcttttcacctgagatggataatatatcaatgtcattacaaggtttgagggaggaatatctcacatatgcatgtgaaaacccagtcatcacacttatgaagtacttgaagtagaaattattttctaagataatataaaacacaggagccactggagaaaggattggtgaattcaatttaattaaaatgtagatgcttttaaaagataaactaccataaaccaaaagaaacaaaaacagcaaacttacaaaaatatttgtattgtataccacagaaaaaaagctaattttattattttgttaagagttcctaaattaataaaacactgatagtctattaaaaaagtggacaagactacatacagacagagcacagaaaaaaaagcacaaatggcatctgaggatatgaaaagatccctgacctcactcacaaaagaaaatgcaaactaaaatgataagaattaagaagttttcggccgggtgtggtggctcatgtttgtgatcccagcactttgggaagctgagatgggtggatcacatgaggtcaggagttggagaccagcctggccaacatggtgaaaacctgtctctactaaaggtacaaaaattagccgggtgtggtggtgggtacctctaatccgagctactcaggaggctgaggcaggagaactgcttgaacccaggaggcagatgttgcagtgagctgagatcgcaccaaggcactccagcctgggcaatgagagagcgactccatctcaaaataaataaataaataaataaataaataaataaataaataaataaataaaagttttattccccacttattaggctcacaaagatgaaaaaaaatttatgaaatactttattgaaggtatgtgcaaacaatccctgacacattgtttggggagagcatggattgataggcctttatgaaggagttaccaatataccaataacctccttggtagtttcaaaaggtggcatctttccctgtttggtattggagacccaatacaagaaatgggaaagtgagcatcaagcaatgcaagctttattcgatggccaaagaatggagaagtgcaagtatggcgcacaagctaacttcttgactagtgaggagtgaggaaattgaaatagaaagtatatctaatgaagaagttggtcattaagagtgaggggaggaatgttcatgtcttttccagaaataggtggtgaacttcttggaaccagagtgccgccttcctttttgtccttttatggcttcttctggtcattgtcatggggattatcaactgtcatggcactggtgggggtgtcatttagcatgaaaatgagattataatgatgcctgaggtcttcttgaagtcctttagtcaactatcttggttctaagcaatctcagctgctctggttacaaatggaacattttacctgtttcttaaagatcagcagagttagggtaggatagaaattcagctatggccctgtaggcgttacactaggtaacaaaagagaattcggcaatattttattatggcaaattaaaaacgcacatacaattatgactcagcaatttcactctgaagcatttgtcttacaaataaaataccgtactgtgaaactattcaagagaatgtcctcacttataagtgagagctaaatgatgagaacacatggacacataggtgggaacaacacacactggggcccattggagggtggagggtggcaggagggaggggatcaggaaaaataactaataagtacttggcttaagaccttggtgatgaaataagatgtagaacaaaaccctgtaacacaagtttccctgtgtaacaaacctgtgcatgtacccctgaacttaaaataaaagttacaaaaagagcccacaaaagagtaggttaaaaaaagaaaaaaactaatgagaagataattattgtagctttgggaaacaacctaaatgttctacagtgtgggaatgactaaataatttgggtacagctgtacaataggactttatgaagctgctataaaaagaagtagctttatacatgctgatacagaaagatttccaagtctgatttttaagtgacgaaggaaggtatgaaacaatgtttatatagggtattatttgcatgaaaagaaaaatgaatagatgtatacatgctgataaaaccacatggatggatacacaaggggttggtactgtggttgtccacaggggaggaatttggatggctgggaaacattgaagagtgagagaattatttttcgttatacatacttttgagttttgtggctaaatttattcttcaaaaataaatataagaatgctatttatggggaaaaaatgggagtcataaacctgcaatttggacctaacttttcaacttaaaaatgttctgttcttggagttactaactgctctgatgcttaggatgataatcaaataatagttcctctaaaatatgtctggaatgaacttgaatgaatgaatgaatgaatgttttttgcaaaccattatgtgtgtaaaaatgtagagtattaatataaggtttatttagaatagagtcatctgcattaaagaaacttcgttatacaaaaatctaaataaaaaaatgttgtacagtagctctgaggaggtggatgacccaaacactgagaaaagaaaagaggcagaggctgagcaggatagttcagtttgaggtaaagaagcagcctcacccagcctcagacaagactccagggactgtgtgaaaaacctcattttggccaggcgcagtggctcacgcctgtaatcccagcattttgggaggccaaggcgggcagatcacaaggtcaagagatcaagaccatcctggccaacatggtgaaaccctgtcgctactaaaaatacaaaaattagctgggcgtggtggcaggcacctatagtcccagctactcaggaggctgaggcaggagaatcacttgaatccaggaggcagaggttatagtgagctgagatcatgccactgcactccagactgagaatctgtcaaaaaaaaaaaaaaatctcatttctaggcctatgtttcccagaaatatgtcatgaaaataaaactgccctcccaatgggaaaacatatatatgcacaaaaaggtaaatatttttaatgttaaagttactgcataattcctttaaagagtaattatatatttctattcatttttgaaaaccagttttagtaaagacaaagttaaaagatgacaaactggcaaaagaaaaaaaaaagaaatttttgtgaaaaggtatcaatatccttagcgtgtgcacacacacccacacacacacacaatcccttggcaaacaagaaaataatgaatatttcaatagaaaaaagatcaagagactaaagacactgaccaaagaagaactagaaatgtttcacgaaattcacattttagataaaaacgttttaaatatcaaattatgaagtttttttttaaatgactatacttaacattgtgggaaaatatatgcttacatgttgctaaaaatgatatacatttttatagcctttctggaaacattttgtcagtatgtatatatatataaaagaagacaggttgggtgtggtggctcatgcctgttatcccagtgctgccaagaggcagaggttgcagtgatggagtgagccgagatcatatcactgcactccagcctgggtgacagagagagactccattaaaaaaaaaaattagccagacatagtggtgcacacctgtagtcctagctacttgggaggctgaggtgggaagaacacttgagcccatgaggtttggaggttgcagtcagctatgattgcaccacagcctgggtaacagtaggagacattgtctctttaaaaaaaaaaatcagtaattttcttggaataggttaatttcatttatttttttctatgcttttcagttttctaaattttctcccaatgaaaatttgctatatttatattcaaccatattaataaccccaaattagtcacatgtgcaactttctgcaaataaatgtgtcttggatttaatggaaatgaaatcttttcagtatagcttctccctgttatttgcgtacaagcttcaaactgcataaactattttaatggcaaaaattaagttagggttaatcaaccatctaggattgtatctgtgcctaggtttctaaaacaattaaatacttgatcgctttgttggatgttcaaagatttggcaatttgtccttaaatatatgtttcaaataaaatatctacaattttaaggtgcttaagtactggtgaacatgtcaaaatgtgcctaatgtatttttaagttctgctgtgaacttaaaaactttgggatttgtgtaatcccaaattagagaattttaaactttagttggtgtccaccatattgtcccccttttcatccatctgaccaaacttttaaccttcctgtttatggctggggaaaaaaaaagctactttaattaaacctaagcagatagtgttgtttttaaattgtatttcgatgtcactaaaatggggaaacaggttgtaatagcagaatccttatattttttgcacatatcagcctccataaaaggatggaaattgctttgtttttcaatgttttaatttttttaatgaggagaaaaagagcaattgagagtgccataaattaaagatagcgtttctgatgtaaaatcaatgatagttatggattattgtaaatgtttgaagatgctcttggaacactgaaaaatcttagaaaattttgttaaataataattaaaattgtcttaaattagtgtgacatctatgttaaaggcaatataattagatagcgtgcttcttcaagtgcttgggttaggagaagtatttcaccatcttcattcatcaagcatttaacaattttatatgatgtgccagatatcatgttataccttggtgataatacatgcctaagacaaatttcctgtctatgaagtttggaatctagttgaaggagacaggcgtgatgaaagaaataaagcactgtagaagtaggataaaaatccgcatttaggggactgctggcagctcaaagcagactggagatatgggagaaagagaagctgatgaagggttgaatttatatttgagggaaggaaggaggcgaagtcagatcttttcatacaagaggtattgagccaaatattacaaagcaagtaatcaggtgatcaggatagttgaaactgttcagataaagggaacattatgaggatgcagaaattatctagctgacctttggggaaattaaacgtagaataatgtagctggaatgtagactgcaaatagggaaacagaagaggctgtcagcatcaggttagtaaaaccttctatgacagaccaaagacatgacaggttattctgtacatagtggggagctgtagattataatttttttttagtcatgggaagattatcaaatttcctattgcagacaaagggtctcttgttcattgaatgaatattacataatttattcaaacttgcttggtgttaggcaactaaatgttttaaggcatttttttgtagcacagctcttttttctcttttttttttttttggaaacagggactcactatttttgtatttttgaagggaaggggtttcatcatgttggtcaggctggacttgaactcctgacctcaagtgatctgcccacttcggcctcccaaagtgctgggattacagacattagccaccacgcccagaaagcacagatcttttttcaaaagaaatttgtgatgttttaataagaaagaaattaaaaaaaaaacagatacaatggaaagatatcgatcctggaacttttaaatcttggtttagagaaaacagtttattatttgaacaacttcaaacactcaagttaaaaagcactaacaaggcacatctcacttgcacaaaaatgataccaattatcaattgttggtggcaacagaatggagcagcacagaaatctggagacccgttttcagttgaatgctcatagttctaaaataggctctgatttggaattccttgtcttacttttcagtttgattaacgtggaagtctcaatatcttcttatgctgtgtgtaggaaaagtatcttgatcagtatatagaagaatatcccacaatgttactgcaactaagaaaaaattaacccattggagaaaacatttttaatcagttcattaagagtctaatgaaggtgcatatacgaaaagcaagatgtactttaattaatgattgatgttttgtgattgaagcttgctttcctaaataatatttctatacttcagtacagaatgtaaggtccttgctaatgccttatttggtttcttagtttcagtcttactgcagtctgcttttattgtaggcttattacatttatcaccatcattaatttaccatggtgttttatctttttaacttgttatttagatcacattgtataatgctttatttctggtcttgtagcaaaggaatgcatacaacaagcatgtaaaactttattgaatagaacagtctttaaaggggaatcatccataagtcagataaatccatgagtagtatagatttatctactgtaaattttctgtcaggctgttaaaagtagggccgtgtaaatcttactgtcattcacattataataggcacacttaccaatataccaactttatagttttttctccccattttacgggtttagggcttattttttttgagatgtcaagtactattttaacattgtacgtgtttcttaagaaacgccatagaatgaagacaatagggaagtctatttgtgatatattctagctcacttacattttttactgtatcttacaacagtaaacatatcacactatacttgaatttaaattttttcaagtatcattgcattattttgcacataaacatattcttagatggtatcaggttgatgatgatgagcttcatggtaattatttaaaactccataatgagatttgtttccaatctaatcaagaagggtaagaatttggggaaaaaaaatctgttctatagtaattaaagttagccatatgggcacttggctctaaagacttggatgtagtgaatctacccaacccccaagactaatgacttggatggtcttactgtattctcttgtccatagcaaagactgatgaatccagccagggaattctccaccagctctgcttctctgaaaccacaaagtcaggaaatgtaatcagagtgctcagctgaaccagagcaagagctttcctaatggctaactgtgactttagaaatcacatccattagataaagtgattaaatatacatcagtcttttggcaagagagccatgaagatattgcaatagaaccttaccacatgacccacatcttttgcttgaaaaagaaacatgttttcacctttgacacatatcatccctaaattcctcagctcagttgcaggaagcaattttttcatgataagttgtatgcagttcataattttatataaaccataaagtaattgtgtggttgataaactttataaggaaaatgtttctgactttctcatttcaccaccctgatgtgtgggtttttgttttgtattattcttctttttaggcttttcatgcttcaagacttcaagatattttgttaaattcttcccttggaagcctttgtgtcgccaaatcagatttttttaaaacttagatatgaatgtcttaagtgtctacttaggaaatatgtgtgtatgtctgtgtgtgcgtctgtgcttatatatagagagcaggcaaattactcttagcactctgaaaaagctttttttgttaaaataatgttttaaaaatattataaaaaaagtcaccgtcaaaatagcattcgctttatatttgtagttgaaataattcctgtttcttactcttagttataaccatcttttgattaataatatactgcccttcacattttaatacacatgcaactaagccgctgatgtaatacatatacttaaaatgttctttttgagctttgaataaccttttgccttttccctggtgatcaccagtgggcaagatgattgacagagaatgtgtttacaaacatggaatcattgatgactaagttaaaagtgacctcataaaatatagttctaattcttatttacagacaaaattctaagagctcaattcaatgtgtctaggataatagtgggcatagttaaataaataataggaagtgattatcatttacaaaatttcattagtgaattactaaagtatacccctatgcatactaattcctcttccccaaatcaaaacttctcatattcttaaatttctgaattcctaaaatcagcagagatgaagggatggaccagcaactataattttgttgtgttttgtgtttctgaggcacatatagggatacctagtttcatgaaaccaagtggtggggacattacacacaaagagaaagctgttaaaggcagaatgcccagacaagaatgaaaatgaaattcctggaggggcatccccatagtttttctgataatctctctccttacataaaaagcttgaattactggtaaattatccatgcaggaataatagaatcatagaatttttgtagtataaggaattttattgacatcatagttgaaagcagtcattttgtaaatgtttttggtgcccagagatactttaattatggcagaggaagttatagacaagtccacgaaccaggagtagaaaagttttcaaatgagaaatattgcagaccaagcatgttaattttattttattttttattttttattttttattttttttgtgagagggagtttcactcttgttgcccaggctggagtgcaatggcgcaatcttggctcgccacaacctccgcctcccaggttcaagcaattcttctgcctcagcctcctgagtagctgggattacaggcatgccccaccacgcctggctaattttgtatttttagtagagacagggtttctccatgttggtcagactggtctcgaactcccgacttcaggtgatccacctgcctcggccttccaaagtgctgggattacaggcgtgagccaccatgcccggtctgaggtattgttatatacacggcaactctagccttataatgcattgcccttatagtctacttagggtttttaggaatattgtgacctaatttaaaagtttgtagagagattctaattttcagaattaacagtactttcattttctctgaccattgaaatactcctaaattgcaaaatgaagtggaagtacacagtagattagtaaaacatatggttcaatgcataaattgaaataaataaaatgagactatttagaaaatgataacaaatacaacagtaaaaagaactcattacataactttgtgacttttttctttttctttcattggttccttacattttgaactctttctcactttttctgtttccttctttttaaagtaaggaatagagaaagagtgtatacaactgaataagtatttattgattaccttctatgtaccccattgggctaaatatgggagtagaaagatgaataagatggtcacagcttgggggagggtgattatgtcaaatcatgatgagaggagttttttgtttgtttgtttgtttgtttgtttgttttgacggagttttgctcttgttgcccatcctgaagtgcaatggcgtgatctcggctcaccgcaatctccgctcctgggttcaagcgattctcctgcctcagccttccgaggagccgggattataagcacgcgccaccacgcccggctaattttgtattttttttagtagagatggagtttctccatgttggtcaggctggtcttgaacttccgacctcaagtgatctgcccacctctgcctcccaaagtgttgggattacagacgtgagccactgcacccggccactactttggaggtttaagaaaagtagttgtaggtttaaaactcttggactggctcctgagggaagaattaaaatgccctattggagcatagccacctatctaggatcttgagtcctagataggtgggtgggaatgagtatcaggaaattgggctgggaccacttaggacaggcccttgtgggttaatcccataagctattgagaagccactgatgattttttaacagaagagagatgtgatcaatttttaattaccactctgacagtactatatattctgtggataagacaaaatgagagtggaaacctagagacttggagaccattgtgatagtacagataaaagataaagagaaaaagcaaagggaaagggtttagggttgatttagaaagtataatcaatagcccttgttgattagatgttactctattctgagttcccagggagtaaatggtactttttattactagcactggctactgactggcaatcatttaaatgagcgggttaaaataagagtatatgaaaaattagagtttgtggaacttgaggggcatatctaggctggaaaatagctacttgtcattttttttttttaatgttggaagactttctattcttagtttgtaggaaaaatgtacatgataatcaacaaaccgttacacatgtgctaaggtggtatattaactaattttcattggctcatgagttacatgctacctggcatcctcttgcctcttcctctctggagccacagattgttagcagagaagctggaagaacctaccatcttgccataggaaaaaggtttggtccttctggaacatgcctgtgaaaagttgccaatttcctatgtaggtcctggacttatctggaattcaaatatgactagacaccatgtattttatctggcactccgatcctatgtgtttttttttaaatatttatcctcctttgtctcttcatgaccttattatacaagttctagatcagagtgtaacagcctctttaaattctgtggcatgaactttaaatgcctgtgaagaatggggctgggttacgattggctaccagtgaattccaggtaatttagacacttcctggatttgttttccgtgtcatcatttattgattacttcatataaagtcttaatgtgtttattactcaggaaaaatgatggaatagtagcagcaatgccacaggtgtgttgtgaacattaattagttaattacaaagcatttagttgagaggcattctaaatagcacagaactcaaggctttcctccccaaccaggggtccacttaaatagctctttactaagtcaggagaaacaaacacatcttgtacatgaggtacatcaaccactaggcatgttgatctcccagggtgattttctgcatgaaaacctatcccctgggtgtcaagagctttctaagagcaatgattcatgaaccctctggatttaggacaatgctatgaaattattttcatctgtattctgaaataattacttgatgtcctattaaagtattttatattttttgccagaagttgtaggtgtaattggaaacaacagaatactcaaaaaaataaaagatcccaaaggagaataagaagaaagagagagaggaatgggctataaagacggcaagagtgatggaccagtgcctaaagattttagacagactctcaaatttactcttcttatgttctctctaaacaccattcttattagttcagcatcactgtaataactaaaaatattttaaaaagtggacaaggcagatgtcagcaaattgatgtggagaaatgggacagacacatggatgactcactcccagtcccaattccctattttattttttcatttgaaatatccatctcttcagagttctgtctagtgtgaggttcaaacaatttaaatgcttttctcaaaactattgtgcaaatgtctgtttttctgtatttttgtgtctttctgatgttcctctcctggcttttcacctactatcacaaattacatactttattatgtacttttatatatcatatacttttcaatgagcttgattcccacctgaacccacgctttagagagaacaatgataggtttctctgcacctgctccatatttagtaagtttccaattccttttggtgtcaaacaatagcaggtatctctgcagtcccttaggtcactaatgtgcttggttttgttgtcagggtagcagctgaaccatatctttcacaaacaggagatacatattttttcccagcttgagcagagcatctcacatttattaggagaaatgcccctagaggcccatctgtgtgtctttgacggctcaagtattatgtactttaagaagtttaatacattttctactggacagtattgagttgttttaaaatattaaaatcttactttgctgagataaataaaaggtattcaggcttttccaagacaagtatgagaaatgccaagttacaacaggttcactaatgagggagaagaaaagtttcatgataatactatgatctttgctattgcatttggaatttagttagacctaaataatgagaagacttttgtgatgatctattcaatttttatggcctatggtctttttgagaaattgattaaggcaggggaaaggggatagtggtagggcatcactgactcttgttttcttgcttgtttactcttttcacgaagtggtaatacaaattacctcccacagcagcacaggttactcaaaagcccagaggagcaggagaatgagacattccttattcatatttcagtaaggtattcttctccatctttgttgtttcaaggcagatgacaaaatttagtagccattttagtgcagaatactcccaaattcagggaggaagctagattcagttgtttttcagtaatattggaaagtgtaatgtgtaatgcccatgtttaaacagttgctttcttcctaacatgataaacttctatcgttagaagatattctcttgggatgaaaataaaaagatatagcataggccccgtttattttatttggggaggaggtagtagtagcggaaaatataaccagcgataccatcttcattactaatgatgacaacttacaacatcaggagctcaggaagaaggaaagcaataaataccttcatcttcaacaggattttctggcaattatatctgtttttgtttgtatgtttgtttgttttgtcctctattaatttgaaatgcctagattgtttttctggaacttagttttatatcaatcaataaaccccttttccctacttttttttgttactttttttcaagagcatactgacctcaacgtggtgaaagttttcaaaagaggcggatataagcttaaaacctgcctctgcccactcctgatctatctcaaatgaacatctgtaactctccatgaattaaaatgaggataataacatgttctaattgttatagaaaaaattacatttgtagcacagggtagctgctttatgcatatttttttctaagttatgcacaccacaattcagtactaattttgtcatgatgtcctgaagaaatcctaaaaatagagattctgtgaaagaacattgagtaccacataatcaagatatatatgtcttgattcattgattgattcattcattcagggcattatatagcagtcatttttttgctacccttccacatggatgatagttaaagactctactgaagccactagatacccatcttatacacaggctgtaatattttaactcctggagtaattggggtatattcacaataaaatcagctcaaatctaatttatttctttcatgaggtctgaaatgtagtcaaagcttccatttagttcctcgagaaaaagcttctggcaaagataacaaaggacatgattcaaatgctttctgtcttacactgctgcttcacatcaggggcagaggattttatgtttcatggccttctcctcccacatattttgggttttctcatctaatcatacagctatgatgtcagtgatggaaatttccacctcttagtttggtatcttgattgttttttctttccctgtttgcacaaaggattgtaggtggctttccagaaaagagacatgaaaaggatcactaaaaggagcttcaaaacaaattagattatttgttgtggggagaaaaatcatagcagcaggaaatttcattgtgccttttacacaagatctaacatgctgatgaattgctagtataatgatgatttatagagctgagtttcttttgaccaagcccagtactcttgcaaggttaaacaattctaatggcggatgacttgaaggactattttctaagcgaatgtacaaattacaagtccttagtttcgtaagatgctgtttcatcaaaggcttttctttgtggtttctcatatttcatattcatgttgactcccaggtgatagttaatggtatcttttttagtagtgctattatcagcttcaaatgaaataatagataataaaaagccttattattaatgtcatattttgatatatttttaactttataaggctttttagtattattaatgtcatattttgatatacttttaaccttatacttcatttattctaagtaatgtgatgtgatcaataatttttcaattaagtacttttctttttgtctgtgctagtttagtttagttgattggaatatgatgttactgtaactaaagcaaagtttggattcctgtaaaaagacttagcatttctccatagaaaggcatatgtacttttagataattctccatgatcctaatctgttatctcacaagtaaagaattgacacttagcattttgagatttaatatgtattgagtggttcttgtgctttgcccctctactcactttacattataaagcatctacataaaatgatttgtacattatctattgtaatgcacacaataatataatgaagatggggataattgctatctccactttttcttttcttttcttttcttttctttttttgaaacacaatctcactctgtctcccaggctgagtgcagtggcacagtcacagttcactgcaacctccatccccaggggctcaagcaaacatcctgtctcagcctcttgagtagctgagatccactcccctcggcctcccaaagtgctgggattataggcatgagccatcacacctggccttccactttttcaatgaggaaaccgtggtttagagaagtaaagacatgttatcacatgcaacaagaaaaaaacagaactgcaattcaaatcaggttctttctcatagttcttaataccatcctatagtcctcaaaccaaaggttccctcttgcttgactttgagatgatgtatagaatcactcttgaaataaaataaatattttatttaatttttttctttttcccagaaaagtaatctagtattttgtatcaatcaaaaacttctattttgaaaatacaagcattcctagttctataaaatatcaacatatgtaaagtctcctaaaagctttgggtttttatatgtgaagcctttacttctgttttctttttgaaataaaacattgattagaattctaaataggttatcacaaatctataatttttttcctataaaacaagcaaagtatatgacaaaaaaatcggtgctcttttttcacctcaccaagaaaattagtgtaattatttcatatgaataagactttttacctgcactacattatttagttaattttacaggctctagaaagatgttatgcaagagaagacatttcaattaatctgatgttgaaagaatgctagttttaaaactcaatgcactctatgtgctaaaaacgtttttgcagcatgaaggtagggatggacagggacatgtttgcctgagttctccagggaagctttggtggtggatgtatgcaaagggcataatctgtggtttccaaagttgaatatgcacacctaagaacaatgctggaagagctttgtcttcattcttatctttaaaagtttcaattttattcaagatcaaggtaatgatagatttaaaaaataatgataaaataaaaaatagtttcaattttgtgtatatttttaaatgcatatgttttacactgcatgtgtagattgtttataatttagcaagcatataaattcatttattgggagatcttttattattattggtattgctattattgagctggtaagggtgatgatcaaaaataattggagactctattctaaacgtgaggtagaaaattttctctgactctaatggtttaatctttaaaaaacagtttaagccacactataattaaagccataatgtttgtaacacttaattataaggatggaaaacttggtcctatagatattatcaccttaaggaaaggcaggaaagctaactgcagtagttgaccattggcacattgaaggggtcatgactggcctgcagtgtcaaaaagtgaccaaacagggacatctccatatggcattcattgactagattggttctattactgattgaagtcatttgtgttttttgtacaaactttaaatagcccaaagattctaaacgattttaaagtaaatgcaatatattattagtattatatagtctatacatacgtgctgatgtgtttgtgcgcttttctctatttatagggcatcataatttctcaaatataaggtataatataatcaggacaagacttgggaacaacatagtatacataataatcacatagttattattttgacaaacatttatgccacacatgcagaaacacaagtctgcaaccctccctatgtattgacattattctgcaagtatgcttacaaaacaatataagagagatcagaatatcctagtattcttaaggttaaaaccgaaacctttcttgtatttcctgaatgaaatgacagattaatgttattgatgaaatgaatatggcttggcttccttgagacacaggctgttagtaaaaaagcaattaagaaaataataaagaaatgaaacagcaattcctcttcctttttcctttcttctgtactgtgtcatagcaaaagtaatataatagcaactaattataggaaatctcccagactttgtaattggatctttcattttttcccacagcaactgtgaactaagaatttattcacagagcagctgtagtttgtttccagtaactcttagcagtgtctctttgtggagtcttaaagagacccatgtacatatttaggcatattggctaaactagtgccttttaaaacatctgcaggtctattgttgccaattctttcattgtcttctatcaaattaacttttcttagacggtataaagtgggagaagccactgaactcaaagctcaaagcctgacttctggtcatagcttcaatgtttccttaaacatgacttggtaacaagcaccaaactttgtaaatctcaatgtcacctttggtaagaaaaatgaaaggaatctttgcagtttatattttagagcattgctatatgtgaaagagctgtgaaaattataaaccagtgtaactcaccatgtcattatatagatatgtctaagttattcttgaatgtgaaatttccatttgcttgacaaatgtcactctattacatacatgatagttaaaagcatcttattttccatttgttccccagcccagttttcaacttttcttctaaaaaggtaaggtcaattaagagatatttccaaaggaaatagttctttagaaaatactttagtatatcaatgcacataataatacaaagaaatgcagttataaaaataaaatatagaataaatacacagctaccatattcttggcatatatttgtacatgaagaaataaacttcaaagccaggcaggacggctcatgcctgcaatcccagcactttgggaggctgaggtgggtggatcacttgagcccaggagttcaagaccagccggggcaacatagtaagaccccatttctataaaaaatagacaaaacttagccgggtgttgtggcgcctgcctgcagtcctagctacttgagaggctgaggtgggagggtcacttgaatcccagaggtggaggctgcagtgagctgtcaatgcactactgcactacagcctgggtgacacagaaatacactatcaaaaaagaaagaagagaaaggaaagaaagaaagaaaaagaaagaaagaaagaaagaaagaaagaaagaaagaaagaaagaaagaaagaaagaaagaaagggaaagaaaagaaaggagagagggaaggaaggaaaagaaagaaagaaagaaaaaaagaaagagaaagaaagaaaacgttgtgatatgattagaggactaagtcttaacgattagaagcctgatttttaaaaaattcaaaaaccaagaatcagtagtagtagttgagaaagtaaaactgagtgaaaagtagttttgcaatcaatgtggaaacactatttggtaaaatgcacttgtacttgaccttcaagtaatagatatgtcaatgttaaaatggcatgttttgaaagaaaacccatgtcaaatagtcgatataaattatagattatatttctcagataattataaattataaaatttctgagtacattcttcccaagatgtgttatttgaggcttttgtcttcactcattttcattaaggagactggtttcccatttgttttctcttttctttgttttcaagctgtaatactgtagagtaaaccctagccaggtgcttgtcctgccttacttcatcccctctttctaacagactacccgtgtaacttcctcaccagtgaaataggagacatagttcctgaggttaaatcatttactcaggttcatacaagagtggtaaagccaacatttggacttataatttcctacaatatgctacctctctagatagtagaattaaatttcaaagagaaatgtcaggagaaattccatattctacactaaggttctcatctattttattttccaccatattattacatagaagttatttaatttaaaagtctgattttaaggtaacctttatactattaactctcctccttgaagtgctacatttacaagtaattaacaaatactgtttgagcaagcacttgttcaggtgccagggactccagtttttgttaatttaaatatagatgcttgatatcatttattggggtgaaagagaataaaacaccttctcacccaccttcctaaattcattatagttaacagagggagtctataaaaatactaggacatagggactcattacattctaacaaaattctaagaacatgcatgtctttccccaggcatttagcttcccctccctcctcctattttttcatatcttaaagtaagatctaaattaaaaatttagaaattcccaaattatgttgctgttgataaaaggccactacatgtgaaatcagccttttctgtgatacattatatatcagagagtcagctattacttgtttgtgcctttaagaaagttaagaccaacttacctgtcattttaaatttgatttccgaagagcagtgtgccagaaatttggcttaaacagaccaacaaagcgtggcttctaggtgttcctgatgggcaggcttttttcaattaacttcctggggattgttttatttaattacaaggacagtttaccagataaactactcactgattgaatttctaaactcaagtctgctgaataaagccaaatgagtcatcgataaaaattcagatgccaagacctttgcaacaggtacatactctaagccatgtatttctgcattttaaagttttaaaacatccttcctctaatgttatcttttttttctatactggcctggggagtaacagatcttagttcaaatcctggctctgctacacacagctgtgttaccttgagcaaagtatctaattccatagataacgctttagtttccttagttgtgaattgaaaaattcagtgaacccaagttgagacgcattctacaaaataactgatttgtattctgcccaattgtcaggtcacgaaagaaaagaaaacaattgaagttctgttgcagataaaaagagactaatgaggtataacaactaaatgcaataaaaaatgatgtaatttaagtaagatttgcaattcagatagtaatatcatactggtgttaattttcttgattactatggttatataattgttaacattataggaagtggggcagggggtacaagggaatatttagtactatttttgctcctttcctataattagctcacaataaaaaatttaaaaaacaaataaaagttatggagagaggagaagccaacaaatagcataagtatagaactgtttttgtacacatgggcgttagacagatagtaatagtaatatcttgtataattttaatataaagagcaccgaaagagaaaaaaaaataagccctaaatcaatgccgagggtgtcatctttctttggaacccccttaatgcagtgactcctgtaagtgggcatgtccctttcatacagagttgcagttgttacaattgataagggttcatgtgagacaagcaattttgaagcagggcaactcccacaactgctcaatgtggacctcatctccttgtatttgcatagatatgctttgctgcatggattgctgcaaaattgctgaaaagactcccatacaaggagaatgcctggcactactcctccgtttgaaagctctggtttctctcttgtatcctgggaagagtgctgccaagtagtccatagacctcttcttatttccttaacttgctgtgtacattttgaagcatttatgtgtcagtttatttaactccccctgcctaataatgataataacaataatagaggtatgtattgagttcttattggttcaagtatgattctagagtgtttatatgcattaactcatttaaatattcaaaatccttttcatactcattttaccgatgagtaaactgagatacacagttaagtaacttaactaaggtgacctagcttttcagtgttggagtctggattaaaaagaaggtagcctggcttgcacttttcagcctttagaaatatacatacgaccatatccatctgctgaattccaactcaactttccttctttcctataccagctcaaaccaatttctaaccccttgtgtttccaaggtacttttaaaatacttccattcaagctgttttgccatgttttgtactatgatcatttatgtacacgtctttcttaaaaaccattagcctcttgggactaggaatattcctgggcaatgtcaaaatactctttatatgctggtgtctccaaagttactatttccaacccagcctcccattttaagttccagagtaacatggttagctacttattggacctgtctactttgtgtctcccaggcatctcaaacacaggatgtccaaaattggatttatcatttttcttccctgttctttaagcctcatcctcctagtttcctctcataagaaatcactggagtattaacttggcaggccaagtcagatacctgaaagtaatcttggatgctcatctcacttctggaatcccgagttcaactgccatttccagcctttcattatctttcaaatgtaaccacatacctatacctcaatatgtttccatacccccaccaatcatatcagttttattcacttggtaaccgatctttctgctgtaaatttaccctctagactatgtgaaaagtgagttttacaaaatatggacttgatcattttcctgcttaatctcttcaaaatcatacatctaccttcctctggaccccctttctctccactttctttgttaaggaaatagtcccttaaaaataatgaaaataatcagtcaatattttccaatgagttagtgtcaatgcccagggtctacaactcagcacaggtatcctttattaagtgtactataaaaggagtaccaaagcttagagcttaatcactggatgacactggaatgattacaactgaaaacagttagtgattagccttggtggatatattggaagcctagaatacctctcagaagatatagaactaaaaacccagccagcctctcaggccgtttacagtgtaaacaaagcaattagagccaaaggagcaagtaagttctaaggaccctggcattgttaaatggaaaaagcctccaggtgaaattgtggtctaagcataggtttctcaacctcagcttaatcgattttgggggcattcctataggaactttagcagcctctctgtcctctacccaccaggtgtccatagcaagcacccttcttcctccatgttcccatgagggaggagagtccgatatctatacagtatatgaaactaggaaatgtatgtaatgattttgtcctgcaccctttattggctttgtcaagacagcctaaatttcctgtatcttagcttttttcaataaattacaaaaatttgacagttggagccatttttctgcgacagtaattggtgattaaatcgcttaaatgccaacattagccaaaatgtttacctctacaaatgagaatctttacaatccctatcctctttctagcaggtttggctaagggaacaccaaaagcacaggcagaaaattacaattacaattgtccctcagtatcagtgagggattggttctaggacctcatgagatactgaaatctggagatgctcaagttctttacataaaatggtgtaacatttgcacataatctattcacatcctaccgtatactttaaatcatctctagattacttataatacctaatccaatgtaattgttgttattctgcattcattaggaaataatgacaagaaaaaaaactctgtacatgctcagactgtgcttatttttcatattcaagaaaggaaaagaatggtctttaagcccaagtttcaagttgtgaacaggtaatcatcattatttatcattaactcagaatcagtacacaggctctgaaaatcagctaaatctgtgaaattctcattccagtggccatgtttctgaaaataaaccagtcaataactgcctcactccagtaactatgcttctgaaagttagcaagtgaaggccagtccaagcttttgaaagtctgctaatgataaactcccagtcccgaacatcaccctgtcagtgcctgcccctatggtgctagagaacagccaatcagtaagtgtcccactctagtgaccatgtttccaaaatttagaaggtcaacggcagtcttactccagtgtccacactaacacagctggaagtccttgagtctctaaacactctgcacatttccccaaaccttatataatgtcagctgtggctttgttccaggaacttatctctcacaaatacagttctctcttgctggcaaacagaacgtttagatttttggcatccaatatttagttcaatttactgtaagttcacaagtttgcaatcctttcattggctcaactcttgtttatgtttagttatgagtttgtacctgtgagtgactgacagtgacaaagctgtgagattatcaaattcaatcttttcaattcctgggtcaattactaatatccattttttatttgtgtagaagtaaactcaaaaatgtcaaaatgcaagtaagttttgtgataaattttatgaacaatggatgtgcattaaacaaagaaaaactccttttgaagctctttgtgcagcatacaattgtttagctaatattgaaaatggtgaaaacttggatgtaagccagcaaatactaacagctaagcaaatagatgtatgatttcctcaacttgtaccaaagaaagtaataaaatcacatcttattgaaagaaattcagatgaagaagataaaataattgcagcacaagttgtcttccactttgtatatcatacaaggttttaagctcacatgacttaatttgaattgtgctacaagtattttttaatgcaaaattgtaagtaaattttctagtgctataggacaaaatctactgccgtaataaaaattagaataactccatttactgttacagagattaccacagctcaaatgttttacttttttatggcatagccatgaatgcaagtaatcacaatttgggggaaaaattcctttactcgtataataattttctcataaaaagacttgcttacaaggctattgtaacacgccttccagatgagtcttcagaaacaacaagaaattgttgcagagaccctatgattgagttagtagtcataaaaattatacttattttgtggaggtaatacaaatataaattggtggatatttgcataaaggtgtgatatttattgaaagttaaagcaaagtataaatgggactatgaacagtgttgcctcttctgccatattctacatgacgctgctcaaacagcatctgatatcagtaaagtaattgccagtaaagaaattgtcaagaaattattctatttcagcatttattctgttcagactctactaatgaagaatttttgtaattttgttggcattcgttattttcagttctttcacattttaaaattcactggctctctttaatagatgcagttgagagaattcttagtttatttaaagcaccgaaatcatactttaattctgaagaaaaggtctcacaaattcttgctgacttttaaaataacccattgagtaaagactacttatttcttgctcatagcattccatatcttttagcaataggattatgcaatttgaaagaagagtaaacattgttaattgatgccctccattgcttacaaagagttgttgaatgtattaaagataaaatggatgaaaagtttatcccttgtatgccaaggctgttttaagaggaacaacacaacttagggacagggaaaaagtccgtattgaagtggataattatttttacatttgtcatgagtatattttgaaatgtattttatcccttgaagaatttgatcctttaatggaacaggagaaattatatgcactcaaagaagggaataaaaattcatgacaatgttctgttttgtcagtggaaaatatttttaaaagttgtagatcaaaatatgcaatctaatcctgaaaaataaaaaaaaacaagttatgtcatgaaatatggtattgtgttctttagcaaaagagtaagtcccagagttaactttaagtcaatacatgttcagaagtccagcttataaggctaacactgaacatgttcaataagctggacttataagctggacttcacgatgttctcattaatgaatgttgaatggagaaaagagaaaatttggatgtgaccactatggaagacatgttacattgtagggggaacataggctttaactataaggaattttataagtcaactctgcaaaacaaggagctgttaatgaaagccaatcatcgaggaaattttcagaaaagaaatctctaatttacatactgatcatttattttagataaacaattagtaaattttaagattaagactgttctgtaaaaacatttccatttatggtcagaatatgtatacacaatgataaataattcaaatttaactgactgtgtattctttttgctaactctggtaactccacctggaggtagggaagaattatcctgttgaggaccactggtttagaccaagataaaatattatagcattcttacaattattatttaataactttattatactatttatatttcttaaaataaatatattcttggatttgccatattttcttgaggacaaaaatatttttgaaatataataaaatataattttaaaagaaaatttaattttaaaatattttagagtattgaaagtttgttttattgtagtaagttagcatcatcaggttgcttatggaaggcttatggtcctgcaagattaaataatggcttggttttgttatatttacatctgtgatttcatttttaaaaactaagaataatagtgtagaagatataaaagcagtgtgtatatttaaagtgaattttaaggacggacttagtccaaaataaaagttttggactgtggatattgcagaaatattattaataaagataatgagcaaaatcatcatatctattttatagtataagaagtaatatgataggaacaatattgaaatggattctgcatttacagactgcattatgtttcttttaaatcactacttctgaggtcaagtgattaattttcaagtgattcagaagaaatgctttaatcacttagcaaaactgtcatagccaaaaggagcttgttttggtcataacctagttcccacaaagtgagccaaaagtaatttctcatattaagcaaagatattgattacaagcaagagaaacaaacactggctgtcccaagccaaatggagatttattggaagttgttgggtactcatgcattcattggaaggctttgggaaactagagcagctgtataggaaaatgagctgacaaaagggaaatctagaggctgtttggcagacccagctggctagactactggtcactgctgccacacaggattctactatagctgtacatagacccagcacaagggaatttcaataaaatcttcctttatttggcttcattcaccaagttcaaagtaaagggcaacagaatccatttgaataagcttaggagatgatggcctcaccacttaaaataacaggagtggaatggaaatatagtcactttagtcactttagctttccacggcaggtgtcaaggctctgaattccatcaccactacacacaatgggaaatacctgttcattctagataagaaggaagattggatattggatagaaaaaaaagtagacatataattaggtcatatcatatgacattctttgtcatttttgactttttatattaaagtagtgatggaaagttagtggaatatgaaacaaaagttacaaggatgagcaataaaataaacagaaattatattaacattgagcaatgaactataacaaagttttgtcataccagaagcaaaagtaaaaagtattatttctcaaagaagaagacactcatctcttatagcactattaaataaattcttggattgtgtaataatccagtttataaagaagagtgaatcatatgaatatgttgaggaaaaatattaggatgtcttgctcatttgccataaaatggccaaacatgttgagataacaaactcttcatacatcactacattgaggatattgataacagagtggttgggtgttgtcgatttagagtatataagattagcttctgaataaggacactgtacaggctctgatatcttacaactcatatgtgaaagaaacttgatggaggtgttcccaaatttgacagtaatactgaaaattttcatgccattaccaaaaacaagttgtaaaactcagagaaatttgctcaactatcagtaatgaacatacacacactatactcagttgtggtaaaagaaagactaaatttttctatcttctccattacaaaattgatacaaagtaaagggaagatcaaagagaatgaagccaaaaatgaagggaagtcctaaagaaatgtgttaaggagtaaattaataaaattttggaatttatggtattggttaattatttttaatacagagacaacttatttaatttttgttctcacttttaataaacattcacttttatattaatctgtcttttgtgcctaatttgcccttgtatttttgcattttttctcaacctcctcccccagttgtataagccacagatccataaaacctggatctgtttataggccacagtgggttagatcaggggtttccatcccctgggccagtgacagatactggtccatggcctgttaggaaccaggctgcacagcaggaggtgagcagcagcccagtgaacattaccacctgagttcttcctcctgttagatcagccttggcattagactctcagagaagtgcaagctttattgtgaactgcacatacgagggatctaagttgcacactccttatgagactctaactaatgcctgatcatctgaagtggaatagtttcgtcccaaaacctacctccttccctgctgccctgaaaaaattgtcttccatgaaaccagtccttggttccaagaaggttggggactgctggattgccaggtgttatcactaagagagcaaataggtaaaatgtctggtaatatacactggaatattatgcagtagttagaagtgcagattagatgtatttacaacaacatgaatgctaagtactttaaatcatagtgcttagtaaataaaaacaaacaatgagaaaatgtatgtaaattagagattcatgtgtacaatattcaattttcaagaaaacagaaagatgttcataaacacattataatggttgctaagcatgggaatgaaaaacaggtagagtggcagagaatgggatatgggggcaatggagaaaaaatattaataaaaggaggctttgcatggccaatgataacaattggccacaaactgggaatttaacctggaacttgaggttaaaaaaatctgtagaatgcaggaactttggttgatattatccacaatacaagtaagttatgatttaacctttagaaggaaaataagctttgtgcatcctttaaaatttttaattagaatagtttgaagactagacaagtacaggaatagaaaatctagagagtttatgaagctatatatttcaaattccatcgaaggacaaagccaaagatgattttttttcttgtttggaaaagttgagagtaagtaaggacaatcagacttgatgacaaagccaaaaatgaaggagacagctcctggatcatagcaaactgttaacacaagagggaggaattgtaggagatacctgtcatagtacagaccagcaaatttctactcatcttccttccctgaccaaaatctttcttcctaagtccaagttaggtgccttttctgtgtgttctcattgctctcatatagtaggtgtgttgtaattgtttacctgctggttttccccaacagactgtaagccctagaggacaaggatcaaggccacctagttagtattgtgtcccaggcacctggcaccttaaaaatatttgttgctcttacctccaaacaacaacaacaacccccccccaacaataacaaacaacaaaaatgggtaacaactagagatggtagatatgttaatttcctttactatggtaaccttttttttactatctacatgtatccaatagcatcatgttgtataccttaaatatacacaataaagtgtattttaaaatatctgttgaagagtaagtaaaatgaaatgaacctattaaaggaatatcagtataatatttcacacatgtgaccattattttcataacttgctgcgggggtaaaccttaaaatcaagactaccttcattttgttttggtaatttgaaaagtaaggaaccgataatatttaggcatttttttactttaatcttttgtagtttaataaagaaaaatttccaaactacattctgttaattgtgctagcaagttattatgatggcattttaaaaaattaatgcaaataataatgatgcagataatcaatttaattgatggctggtcacttaagatcgctttctaattttcagttattaaaaggtctttcaaaataaggctacttttgtaaaaaaataatttttatactatattgtacattaagggaattcatggatggtgttttctacacaacagagaaaaaattttatgtaaacctgagagcaattactttaccaattaaatcactcaaatgttgtagactaaaataattgaaagtcaaaataagattaaagaaaatcagttttcatatacaaataatggtaagggattcaagaaaataaaaattggacttaatgcattttaacctatatagttttgaaaaccataaaacataaaccttattgctttgtgtagtcatttttcacctttgtagagtccatttttccttacatgtaaacaggcgcctattctaatattcttcatttcttgctgtgtttccattctttttgtctaagatcttttccttctgcctaaagtacttcctttagtgtatattttagtacaatgattaattctctcaacttgagttttcagaaaaagaagtttttaaaaacattttacgttcatctttttaacttttcattaagtataacatacttaaataaaaatgcatatatcatgttctcgcttataagtgagacacatagaggggaaaaacacacactggaacctttcaaatacagtagagggtgggaggaggcagaagatcaggaaaaataaccaatgagtactaggtctaatacctgggtgatgaaataagctgtaaaacaaacccccatgacacaagtttacctatgtaacaaacctggacttgtactcctgaacttaaaataaaagttaaaaaaaaaatgcatatatcctaaaaatatagtttgatgaattcttcacaaacgaaacaaaccatgtaaccaatactgggatgaaaacacagaattccttcactctagaataatattttcactctctctaatgttccagagtgtcagggactacaaaggctacaaaaccaaatgacaggtctgctttgttccaagcaatgttacaggctaaagatacactgcttgtaggatttcatactcttaaaagttcccaggtacataaaattctactaattagttaaatgaagctgtgtattcatggacaatagttaaattgtgacacagatgagtgtacctagcaccttgttagagaaagctccttagtatcaatgagatgtgaaggacatctaagagttatcagggctagaggtctggggagagttatcctggctcatgctagtcttttagtgaaatggcctggacaaattcatagtgaagatgggcagtcaattgataagattatattatatttgactgtttatttctaataagattataaaaagattataaagttaaaagcaaattgaggtgttgtagtgaggaaagaggattgtatagattcataatggctggctcaattccagtgtttttactctacttaagtgtatagatttggttaatttttaaaatttcaggtaacaaataatatggtcatcattgaaatccctaaatataataaattacaaccattgtttttactgaatctagactaggggaagagtaagataaaacaagataagtagaatgttggcaatttaaaaaattgtgccaggctcagtggttgatgcctgtaaccccagcactttgggaggccaaggagggcagatcacttgagcccaggagttcaagacgagcctgggcaacatggtgagaccttgtctctacaaaaaatgctttaaaaaattagcccagcatggtggcacgcacctgtggtcccagctacttgggaaggtgggaggtcgcttgagtgcacgaggatgatgctccagtgagccgtgatcacagtattgcactgcaacctgggcaacagagtgagtgagaccttgtgtttataagaaaatttatacctttcaaaaatttaaactcatactttctgcccatattacagctgcctccttctgtggtataaacgcaatattaaatattgtgtttatttttatcaaaataagacagaaattctcaagacagaaaatgaaaagttttgtcaaggggtttcacagacctttcattgaattttaattgcaatgctaaacaatatttgaagataacccatagtggtcccagtcttcagcctgaagtcaagaacctttagttatctgaatgttctcaagctccaagactccctaggatgttatttaagcaaagtgcaggatttccaaacactagtgattaatatatgacatctgcttactacagcactgttgtgcagccacaaaatctttcagaaaagttcacaataactatggcttactttgataaagaatagtcagtaggatggttagtctaatatgctctcataaaaaaagaaaagtattatgaggtggtgccaggaccttgggtcctatttggctatttctccaaggatctctcaatggtaagatcatcatatatctaagcttgcctagaacagtccaaggtcattcctgctgtcttggtattttctgtgttgtgtagcatttattcttgacacaaaatcctggcttggaacataaatgctgtagacatcctgccaaggattgaatcaaatttataagtgtaaccctgacagctagggtagagctgtctatttccttcctccaaagatgttatcaggtatttagattagtaaaatgagaaatactgagatacccttataattcaaggagcacataggaatggatatagacttggtttaagtattatttttcccctgtattctccagattcaatcgtttcgcacctttgactttcttatctaaactgtagagctattcaatgactaaattgtacttcttattgtctttgaatgtttcagctttatcttgttattgacatatagaatttttattatcttgatatttcacttattcaatcggaggccaggtgtaggaaggactccaatattttcttggtgccaagacatagaacagagttttcagatccatctggaaatttttctgttttcatgggagaaggcctataagagttcatactggaaggaaacattgcctctctcatctctcctgatgacatatttctcttttatcatgggaagtcttatgttatgagtagataagttatgaaggtgatgttatcgaacataggagagtaatttaaaatattattgacaaaaggggcttttgtagttataaaccagggttaagcgtatccttgtcagccagagtggagctgtatttttgtcttgctctgatgatgttatcaggtgttcagagctcagtaaaatgagaatctcagagtcaaatacatttcttttatctctatgttacctcacagttcctaaagtaacacagaaatcaaaagtcagccttttgtaccttaacggcatcattaagatggatatgtaataaagcttcaatttaacaacttaaaagatatttagtatgcttaccatggttgagggagttaaattgtacttattctaaaagaaaatacacacagattccctcataagtgtatttttttagcctattataataagacataatgactctcaagtataattaggactcagacattgtgactccagtttagttctatgtttataagtcataagctcattcctgacccaggagagtgcatttatagaaaattatcctcccaggcatgattactttaagaaaactgatcagcatttctaatggatctcctattgatcaaagcaatgctattttgtactgtgtaaaatatgtatttttaatgtattaattgtaattcattttaattaaaagtggttcaaatttatgtctattatcacttaggtatattatagataatatagataatggcaatgcatttacctgataaattcaaattcactgagctattattacctttatttaatattagaataattctacatctgtgatttccttttgcttaaacttttgtcttggaatagatttatggaaaaatggtgcagatagtaaggacagtttcaatataccccacatccagtttcccctgttattaacagtttatattagtatggcgcatttgtcacaattaacaaaaccatgtgatacatcattattattaacaaatgcccttaccctattcagagttccttagtttttcactaatttcctttttctctttcaagatctcacccaggctaccacattacatttaaccatcataccatcatatcaccttaagcatctctaggctgtcgcaatttctcaggctttccttgtttttgatgatgttgatactttgagtgagtataggttaggtattttgtagaatgttcctgaattggtatttgtctgatatttttctcatggttagattaaggctataagttttgggaaggaagatcacatatgtaaaaggccattctcatcacatagtatcaatggtacacattgtcaatgagttatcgttgttgatgttaactatgatttaaataaactttttaggttctcatgttctgattctatggtgccttgagaatgctttaaaaattaatggtacttcagtcaagattttacctgcaggaaaaaatcactatgtgtttctagagaagtgacattttcaaagcagtatttcattttacaacagttagcatcaataaaaatgtattttttatttatctttacatttgtccactgtcttaaatatttatactgactcaatctcattcagattttggcagatcttccaaatgattaattggaccaattttaaataaataaatttatttatttatttgagatggagtcccgctctctggttcaggctggagtgcagtggcgcgatctcggctcactgcaacctctgcctgctgggttcaagtaattctcctgcctcagcctcctgagtagctgagattgcaggcgcccacaccacacctggctaattgttgtaattttatcgaaataagattaagttatttacaggtaagaggctcagtgatggaatgcaaaacagcctgaaattattatagagttgtgagcatgtagctattttcctgctccttgaaataagaaaatatagagttgtgagcgtgtagctattttcctgctccttgaaataagaaaatgtcatatcatagtccctctaatcaagattaaagaaacaaacaagtaaacactacttgctttctacaagagatgtcaaaagttatcaaaggaaacatactgtttaaaggaattatctgggagatatttttaagagaataacttattctcttaaataaatatagctttcatatataagataaacattaattattacaaaagcacaacatattacaaaattatatggacataatatgcacatactctaactgagccacaatagaattggtgccctgacactaataaatcatttgggaactgcagtttggagtatttagtacctgttatgtggccaagaaggtaatagaggccactgagaccttttccagtctaatataatgggcacaactcacattttttccttttagttattaggtaaaaattagtgttggtgtttacttcagtgattttttagaggatttacaatttttactgtgaacacttagggaaacccacttcccacctcatcctatagattttccctatgtgaagggttttcatagtaccttggggatgaaaggaagtcccccaaataattttcctgatgtctgcttccaatatttgacttcaagaataccgttttccaaatagtatgttcagagccataccaggcacacagagtctctaaaactctggagagactgtaatatttctttgcttgaaggaagggatcattcttgtattctgttcagagattacattaatgatatttaaatgtttctcagaagataaaccaagtgttggaatttatttgcttttgaccctgttcagcaatattcaatgaataaaaaagaaaaaagtcttaatgatagttcttgagccacatgactttgtctaattaaaaaatattttgcaagtcttcatataaagttcaaaacaacaaaggtgaaatgatgggaattttcttaagaaaggaaattctgcagtgacccaatcctttgagcaatcaacagtcattctagggatactcttgtattgtttaaaattacattttacaaaataaataatgtcctaaatgcctcaacatttttagaatcagaaaagttgcttaactgggatgtccaagatcatttagctagtaagtagtgaatccagtattcaaaacccaggctttctagctcctgaacttgtcctagactcactactctaaactaaatctctgtttaatattacatgctcatatgaaatgtttcatgtttaaaaggccaatacattcccataaatggaaatatcctcatttaatataattaatatattttaattatggaagcatgataaaattatccaaagcaaggaattaaaatagaaggatgagacaagttaataatcttatgagctccatgaatacgtgttcattatgtgcaaaactcttcctgttaagcactttatatacagttaaccatcacaatctaaaccactcttcggagcatgattattaactcaatttttcaaactaggaatcttaggctcagagaggttatgtcatctccacagggtcaacagctctaaaatgtggagcacaaattgtaatgggaaaggccaagatgattattgacctgtgagccactgaaaccagtgtgaattgttctgtatggaatagaagtacacttcatgatatatattgtaactgttgctgaaggattttattcattttacattggatcaaatggaaatcgagctgtatattaaagattttacaaaagctccaaattaagaagaaactatagaaactcaaataaaatgaaattttttttaaaaaagtgttttctaagtagtgtttcataaagtaatacaaatttttagttattaggctgataaaataaatctatttcttttagtatctttgtcctttctttttgaatgttgttacacattcctgaaagttggaagatcagcgttttaaaataaatgctaggaaagacctaatgtaactcttgattattttacagcatcaagagttcttccttcttcttgcttattgcttgacaacagattgactgaggatgctttagagctgacaggtttggaggatgagggatgagtgagtatgagcaaaactctgaggaggagcactgcatgcctcaaaagaacttggagagaataagagttaccaaaaaaaaaaaaaaaaaaagattttgccaggctataattggaatgaagtgatataagtgacatgaatgatgcttaaaatgttgagaattaaaaagtaaatattaaaacattgaaaaacttttttttaccctttttggtttatcatcttccttctctccttcaacttccatttttttcattcagtttttcccctcattccaactcttctttctttaattgaacataatagagactcggagttcaaaatatgtgttgtttctattgaattgatagattttttttttttttttgagacagggtctctgtctgtcatccaagctggaccgcagtggtgtgatcatggctcactgcagactcaacctccccaggctcaggtgatcctcccaccttagctactctcaagcagctgagactacaggtgcacagctccatgcctggctaatttttgtacttttcctagagacagggtgtcactgtgttgcccatgctgttcttgaactcctgccctcaagtgattcacccgccttggcctccgaaaatgttggaattacaggcacgagccactgtgcctggtctattgaatggaatttatgtttatcctttccaattttaaaatagttaactttaaagttgtgtattttacattcattgtcttcaaaccaaacaaaatccaaaaacttttctactttttgaattgaattttttctctccttttgaataataaaacctggtcattgatgtatgtgtactcatctgatatttttgatttaacaaaatcaaatggagggttcacgttagtattttatgctttttaaaagtagacatgcttatgctcttccctaaaacttttatttcagcattacttagataagccctggcatctgtatttttttaggttacacagatgatttttttgtataccctggtcaatagccacagtggagtatacctgcattctgatatatacactcttgacaaccatagagacaaatgatacttagctgcatttttaacattacctaacataagtgaaagggattttaaaacagtagtattttggaaaacagcagataataaaacattaattttgtgttgtgggttattggtattaagtatcatgtaatgcccacatctcaaagctcactatggaagaattggtgtcagataataggaagattgatattgttgaaaaccatgcattcagcaagccagccattggtagcacccaatgaagtgttcagtattcatctaagcagagaaagtagaagacacaatctttactgtaactttgagtgtttgcagtgtgtcagatggtcccttgaagaagaaatattaataaaaatgaattgcaaattgtctccaatttacctgaaagagatcaaaataatgtatctaaatatatggtgtttgaaaggtgtagagtcagtccatatttttcaagcccagtgaaggtaacagaacagtttctacttaagcagctgtttgttggtttctttggctcaagagagaggtataatatcttcttttattttacagctttttaatcataataataactattataaaattaacaaatgcacatggtaactaattcaaacaatttttgctttatccctttaaagccattatctagggaataatcacttcccgcttttttaaaaaaaagtttttctgatattttcctttttatctctaaataatatgcttatgtctcatttttatttcatcaacttatgtaatgttttctaactttctaatttgaaaatgaggaatttattttatttatgtaaacttttctctttctgccccattctcaaattccaagcagttatgttttcatttctaagtaattctatgggttggatttatacctttaaatggaatatacctgaacctctatttcttgttacttaaactttagccaggatgcactaactgccttcaatgtaagataaggggtcagctctccaacttttccctcaccactaatccccctctacctctcaatttttgtaagctattccattacttttacactgataatatttaacacatatatgtgtatatcttgtctttgtgtaaataaagttctataattgtacttacattttatatatgctttggtaattggcacatttgtgagatgattaactgatacaatttaacaatattataattatgtatgtatttttcattttaaaacaagtaacatggtttgatctagaggaggaatttaaacctctcattcaaactctgctacttgaagaacacatcaaactcaagtggatcctctctgcttcaattctaccagttgttcaagttcatgcctcattttgaattgattcctatttggacaatatggctatttacacgttctaaagaaacaaattccctttgcttttattcacactatttgtgaaacatcttgtattctatgtgttttagaagtacttttttttttttgctctaccttaatccaaagtaacttaaaaaaaaaagataaaaaggagttaaattttgaattttcttatacctagaaatatattttgtttgccatcacacttgataataggttgtctgataatagaatttgattcaaaatattttctctcatcacactgaaagcattgattgtgttctagtgtcaattatggctaaggaaattttaatggcaatctaattttcattctttttagttagttatcttatttttggaagattataaaatcttgtttctattgttaatgctctaaactttcacaagaatggaacttttaaattgatcttcttttgtacttttagcttgatgactcttggtgaattttctgccattactttgtttattatttcctatctactatttgctgctctcttgagactaatgtcgaacaacatggattattctgtatcttctaagttttattttgtacttttttaatttttaaaattctcctaaaatatatagaaaaatctaagatatagaactccatgcatttttacatatacatattttcccatgtaaccatcacatagatcaaggtatagaacgtttctagcacctgagaatgctcactggtgccccattctggtaaagtgccccttttgggtaaagtaaaaggtaactacaattatgacttctccttttcagcaagcattctactgaaattttttgtttcacaaagcatgacctttacccagaattgatgttgttgtttttggtagcctattttttttttttaataaaagatactctgtctcctcaaatttctctaggaatactaactttaacttctcaatatcccacaatgtttgcttttttttttctaaagttaaaagtttggtctgttcatcttagtctttcaattttatgtttggtagatcttcattaccaatttattcttgataatctattaatatttatggaagaaaggccaggttggtgttggccaggtttgcatctgtctttatacaggtctgtttcccagacaaatcctctcttgaaagagagggatgactgaaaggtctgtgtatatacatgtatggtgtactgacaggcaggctacattttaggatgtatggatgaggagtagataagggagtcacctttccctcgactccaccctggttctagctaaaatggacatggataccctaggagtcctaccttaattaatgcagatattatccttttggtgatagcttggagataaaccactctgctacatatttaacatagagagggaagtgggacaatgttttctgcaacattattgaataaataatccatggattaatcaacttgttttctgatctacatcacatatttgccatagaaatctgtgacttctctgctagaaagaaattctaacattctcagatgagtgttctagactgtagcttctgctttgatctcctcactagggtaatcttatgatttatgataactttttttgtcttcctctggtttttagtgatattatctaacatttcgccactgtacatctttgtttttactgcaatggaaatttgaaggccagagagtgtgataaacacatgggataagaccattttcatgaactgggagctgacattgctttgactggaaagatgtgtgaagaaaaatagatgctagatagacaaatacatgatatgatatttggacagacatagatccatagatggataagcatagataaaacatatctatatatatgtgtgtgtctgcatacatagaaaataagaaagagttcagaataaatatttccatattgattttaactataggaaatcttagatacaagaataacacattcattttttaattttagtagttgcctaagtattctctaatatgagattaatggtgagtgggtaagatagtaatgagaaaacaaaagtactgcctttatatgcaacattgggatttcattctaaagaagatacaatcatagtaatgttaataaaagtggaaatgtagcaatatatttttcaaaattgtaaattaaacatgacaagaataaatattgattgatttcattgactatataaaattaggtcaaataattttaaatgatttttttcaaagtatattttctttcttctggatagaaaaacatgacattttcgttgtacaaatttgaaaagtaaagtataaagacataaaaataatccataatctcttaactagggctaaactttgttaaatgcattgtgtatttaaattaaatatcattttaaaaattattattaatttacatctatctgtgtgtataacctggattccacttattatgcattatatttttataattcatttaattcattaaatagtctttgaacgctctctttcaaagctgctcattatttcattatacattcattacttcatttagtgtaacccttactgttaggattttggattgattataatttttcaatattataaaaatattgtagtaaatatatttatacatgttagaggacacctgagattactgtctttgaataaattcctagaaggaaaattatttggcaatataaacgaattcacgtgtttaaggcttttgatagatattacaaaattaccctcaaaaagtttgtacactttatttatttatttgagacggagtctcgctctattgcccaggctggagtgcagtggcacgatcttggctcactgcaagctccgcctcctgggttcacgccattctctgcctcagcctcccgagcagctgggactataggcgcctgccaacatgcctggctaatttttttgtacttttagtagagacagggtttcacagtgttcgccaggttggtctcgatctcctgacctcatgatctgcctgcctgggcctcccaaagttctgggattataggcgtgagccaccgcacccagacagtacacattatttattactttcatccagacaggcaacactgatttcccctataacctctctaatatcactattacttttgttaaaatctttgctaatgattaataggccaaatttggttccccatgtttattttaatatttgtttctttgattactagtgaggtttgacatggttacaagtgtttattaaccatttgtatttttagataattatgttttttactaaattttatgagatatattaatatctttattcattaaaggaaaagcacttcatctgtcatttgtattgtactttttttattttgtggatgccttccacttttaaaaaccttcattgttatgagattaaatctagcattctttatctttttcgattttgcctttggtgtaatgctttacaagtcctctctactctcacattaaataagtattcattttcacttttattagaatgtttgagctttatttttccatttaaatatttactccaccagaaatctcaaatcttaaactaaatgcctgactaatgaaaactcctgtggcctgtttatccagaagactaagggaagaggaaagaagttgtagtcacacataggtcctgccccatcattgcatcttctttgtgtgtgttggtgaagtgtgaggctccatttttacttatgttgccctctgtaaccctgtcagcctatcatcttgccaccccactggcctggtacaataacttccaagcaaactcagatgccaactaaagctgctcttcttcaaagctataaaattagtaaaatgaaaggaagtttcacctctccaaactagaggatgatgatgaaatctgatcaaggtctcttcaacttccatttcacagatcatgatgttaagcaggtgcttagtgtcttcctttaatttagcttgatcagggaaatattgcccatgcatggtaccactagcattgaccaccctttgcctctgcttttttcatatactttagtcattctggagctgtgttgagcatgtgcatgggggttgggggagacagagacagaggagaataggaatattggaagaatcaaactggtaatggacatctgagttcacaacatctttgtacctagatttctgtcaaataattcttgaaagagatggtaccctccagttgaatgtagaatctacaaaaacaccagttattcaagccaacttttcttcaagagccacagtatgtctacactgaaagtctagtgaggcaagttatcccgtcttctcacctttatgatttccaaaagtgttgaggaatctccaaagcacaagtggcaactgctttgatttgattcattgatttgtttcctttttactaaatctcttcctattctgaggacaattttcacatattttaggattcaaaattcttaatgcatattcatagtagttttattaagatataatttacacaccataaaaaatcaccattttaaagtgtatcactcagtggtttttagtatgttcacaaaggtatgcaacaatcatcattatgtagttttagaatatttttatcaccccaaaagaagccccatactctttaaccattaaccacataaccatcaataatcacttcctattacacccagcctctgacaaaaaatactctacattttgtttctggggatttgcctattctggacatttcataagatggaatcatatcgtatgtggccttttggctctgtgttctttcacggggttttcatcacatccatgttgtaacatgtacctatacttcatttgtttttattgctaaatactaattcagtgtttgaatatcccacattcctttatccatttattcattggtgagtaatgaggttgtgtttactttttggctagtatgaataatgctgctgaacattcatgtaaacgttcttgtgtggacatatgttttaaattcccttgagtctgtaccaagtagtggaattgccgagtcataacttactctttacctttcagaatcatcctacttttgaatgtgtatatgaaatatcccttatttttcactacattctttaaaaacctttatcctaactttggtttccatcaaaatacaggcatacttcattttatggggctttactttattgcacttcaagatactgcattctttacaagttgaaggtttgtggcaaccctgcattaagcaagtctgtcagcgtaattttttcaacagcatgtgctcacttcatgcatctgtgtcacactttggcaattctcacaatatttcaactttgtaattgccattatttaattattactgtatgtgttatggtgatctatgatcagtgatctttgttgttactgtggtaattgttttggggtgctatgaaccacatccacataagacagcaaacaatcattaaatgtgacgtgttctgtttcagcatccctatctctctccctttcctcaggcttccctgttccctgacacacaacgatgttaaaattaggccaattagtaacccattcccacccctaatgttcaagtaaaggaagaattgcgcatttctcactttaaatcagaagctagaaatgattaagcttagtgaggaaggcatgttgaaagccaagataggccaaaatctaggcctcttgcactaagtacttagccaagttgtgaatgcaaaggaaacattcttgaaggaaatcaaatgtgctactccagtgaacacatgaatgataagaaaacaaaacagccttattgcaaatatagagaaagttttagtgatctagatagaagatcaaccagccacaacatttccttaagccaaagcctaatccacagcaaggccataactccaattgtatgaaggctgagaggtgaagaagctggaaaaaaaaggtttgaagctggcagacggtaccccatgagattgaaggaaagaagtcactgccataacataaaaatgcaaggtgaaacagcaagtgccaatggagaagatgcagcaagttattcagaagatctagctaagatcattgataagagtggttacattaaacaacagatttgcaatgaaggtctaacagccttctactagaagaatatattatagctagaaaggagaagtcaatgtctggcttcaaagcttcaacgaacaggctgactctcttgttaggggataatgcagctggtgactttaaattgaagcaaatgctaatttatcgttcagaaaatcttagaattatattatttaattattcagaatattaataattatttactattcagaaaattacataataattatattatttactattcagaaaattacataataattatattatttactattcagaaaattaaataattatattctttactattcagaaaattaaataataactatattatttaattattcagaaaattaaataataattatattatttaatcattcagaaaatctcttaagaattatactaaatctactctgcctgtgctctataaatagaacaacaaagcctggatgacagcacgtctgtttacagcatggttcactaaatattttaggcccagtgttgatacttatagctcaggaaaaaaaaaaaagatttctttcaaaatatcactgcctattgacaatgtgcctggtcactcaagagctctaacggagaggtacaagggcattaatgttattttcatgcctgctaacgctatccattctgtagcctatgggccaaagagtaatttcaacttttaagtcttattttttaataaatacattttataagactatagctgccatagatagtgattcctctgatgggtctgggaaaagtaaattgaaaatcttctggaaaggattcaccattctagatgttattagaacattaatgatttgtgggaggagggcaatatacaaacattaataggaaattggaatgagttgattccaactctcatggatgactatgagaggtttaagacttcagtgatggaaagaactgcagatgtggtggaaatagcaagagaattagaattaagagatggagcctaaaattgtgactgaattgctgccatctcgcggtaacttgaatggatgaggagttgcttctgattgataagcaaagaaagtggtttcgtgagatggaatcttctcctggtcaagatgttatgaacattgttgaagtgacagcagaggatttagaatattacataagtttagttggtaaaacagcatcaggctggagagtggtgctaccaaaggcattatcataaagacttttaaaagaggaaagttgagttgaattgcaccaaaggtaaatatagacgaaaagaaggggaatttaggaaaatttactcagaaaattgtcattttttactttaaagctatgaagcgtaaacttcaaatttctgagtataaagatggttagaaggcacgaaagataagtcccgcccattgcctgacacatagtaatcccttaacaagctgataattctagaacatgttaccttttgtagttgaaactaaaaatctgtttatgttgttattattagtttttaatgggcctttcttggcaggcaaatagttaagtctttatttctttgtttccatccaggcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaaggtgagtttattttgacttcagtggtcagtttctgttggcttccttctgtataaaaattattttaaattgagattagtgaaatttagtgaataaccatatcatgaccagaatgttaaattaaatatatatatatatatatatatatatatatatatatatatatatataggatattcagaatctgtactttttcaaatttttcattgaaattggctctggcattggcatactacttttaatttttttttttaattatactttaagttttagggtacatgtgcacattgtgcaggttagttacatatgtatacatgtgccatgctggtgcgctgcacccactaactggtcatctagcattaggtatatctcccaatgctatccctcccccctccccccaccccaccacagtccctagagtgtgatattccccttcctgtgtccatgtgatttcattgttcaattcccacctatgagtgagaatatgcggtgtttggttttttattcttgtgatagtttactgagaatgatgatttccaattgcatccatgtccctacaaaggacgtgaactcatcattttttatggctgcatagtattccatggtgtatatgagccacattttcttaatccagtctatcattgttggacatttgggttggttccaagtgtttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttaccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccttttgtcagatgagtaggttgcgaaaattgtctcccattttgtaggttgcatgttcactctgatggtagtttattttgctgtgcagaagctctttagtttaattagatcccatttgtcaattttgtcttttgttgccattgcttttggtgttttagacatgaagtccttgcccatgcctatgtcctgaatggtaatgcctgggttttcttctagggtttttatggttttaggtctaatgtttaagtctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcgttatttctgagggctctgttctgttccattgatctatatctctgttttggtaccagtaccatgctgtttgggttactgtagccttgtagtgtagtttgaagtcaggtagcgtgatgcctccagctttgttcttttggcttaggattgacttggcgatgcgggctcttttttggttccatatgaactttaaagtagttttttccagttctgtgaagaaagtcattggtagcttgatggggatggcattgaatctgtaaattaccttgggcagtatggccattttcacgatattgattcttcctacacatgagcatggaatgttcttccatttgtttgtatcctcttttatttccttgagcagtggtttgtagttctcctcgaagaggtccttcacatcccttgtaagttggattcctaggtattttattctctttgaagcaattgtgaaatttagtataatgtttagtataacatagtatacattgtttagtataattgtttagcataacatttttggacatgacacagtgatctgccaaattttataatcatacctattttttcctgctaataattaactctcatgtgtatgcagacccaaaaatcacttaaaagtttttaatgagaatgaaaattgctaatttcaattttaaaataccaacaattctttttattaaaatttcaagtataaggtaacttgatcttgccaatactatgtagtatgttgtgatttttcatgttagctcagatgacctccggtttataaagtctccctgataattttgacagtcatgtgaccctgttccctcttcactctcattcttccccctttatatttttctgtatgatatctgtcacatcttgccttatattagttactttcttcttttcatttttctaggaagttccttgaatacaaaactcatgccttatttttgttcaaactccttttcattacctgttatgatatagtttctgactatacatgtattagtcttttttttttttttttttttgagacagagtctccctctgttgcccaggctggagtgccgtggcgcgattttggctcactgcaagctccgcctcccgggttcacgccattctcccacctcagcctccagggtagctgggactacaggtacccgccaccacacctggctaattttgtttttgtatttttagtagagacggggattcaccgtgttagccaggatggtctcgatctcctgacgttgtgttctgcccaccttggcctcccaaagtgctgggaacacaggcgtgagccaccacgcccggccgtattagtccatttttacactgctataaagaactacctgagactgggtaatttataaagaaaagagatttaatttactcactgttctgaatggcaggggaggcctcagaaaacttacaatcatggtcgaaggcaaaggggaagcaaggcacatcttaacatggtgcaggagagggagaaagaggagggaaatgccgcacttttaaacccatcagatctcatgagaactcactcactcactatcatgagaacagcactggggaaaccgctcccatgatccaatcacttaccaccaggtccctcccctgagacgtggggattacaattcaaaatgagatttgggcggggacacagagccaaaccatgtcaatacaattgcagaaagaatggatgaataattttttaaaaatacagtctactgagatttaagacaaaaaggattgtacttgaggactaggtattaattttaaaataattttccatgtaaaagtgaattttacattaaattgtatttagatagaactgatacagtgaaagggagcaggaaaataaaaggacacctgaaaacaatagactctgatttgttttcttgagggaacgctgccgcatacaaataaaaagcctgactcacagacttacctcctgaatacggtgagaaatgcttattgccagaaacccactgataaccctatataaaatttagaaagtcagtgtctttcagctaacacaagtcatcttcctgccaaccggagaaaaataaggctgggatttgaactttgtctttctgatttctaagccaatgctttaggttgctttaatattttgttgttactgctggttgtttttatttcttaactgaatactaaagctatggaaaaggacacttatggaatggctacaataacatttcaagaatgtttgcttctattcatatcgttttttaaattaccgtggttagtaagtgaggaatcctcttaatttaagtcccttttaaaagctaatattagtattataactaaaataaagaaattgaactcagtgattggaaggattcttccaactctgacgttccttcaacttaggaaaatattttttgaaataactcatattttggaacatgtgctgctaaccataacaattgccagcaagtattaaaattctcaaggttttatgataaaaatattagagatagctagtttctatttggctttcttaaaatgcagtgtaatggaagggaaagaagttgtactttaaaataacttaaccacagttattgttactggtgaaagaaaatgaaaaatatgaaatacagtattttgaaagctctaagcaatacatgctaacaaatagctcaatttttaaagttactatgaagaagtggacttggagttcattggccaaggtgacattgatagatgcgttgatgacattggaaccacattgctggagtctgatggcagtgtttcttcaatataacactgccatgtagaaaggtaaactgctgatattgatgtgaaaaattgatattttggattctcaatttcatcctttctttttcctcctgcagactttcatagtattgaacaaagggaaaacaatcttccgtttcaatgccacacctgctttatatatgctttctcctttcagtcctctaagaagaatatctattaagattttagtacactcatatccttttaaaaatgattacatccagtggcactttatggtgtaatttttgctattttattcaaatatagatgttataccttttgcaccttgaaagactctggttttagtttattaatttcagtattattaatataatttgtcatgggtctcagagaagactgggagagtggcaatattaagattttaggatatgttacttttatttattactctcttgttcaaagagacaaaatagtctacaagctcatttagaatttttttcttaggaaaagttgtaagcatttcaacaagtgtcatcctcaaatatttcaaattcccactgtcgtctcttttgttccttgattctaagctaccttattcagcatgctcatcatgtgcactattctgacaaactgcatatttatgaccatgaataacccaccggactggaccaaaaatgtcgagtaagtgggtataagtacattttaatatagttttggtattatcatttcatcctttccttttcctgccaggaagttactgcatttatgaagatggggaatctttaccttcccatgttatatgcttgcttttcttttgttctttacctcctctatgatattaacctgctagattagaaaaattagatgctacagtgttttctcaaagaatgaacttgtcagatgctccatcctgttcttagacatgttacacatattttattcttgggtgtatgttttataattatatgggtgtatttttaaatgattgggtgaatttttgatagaagcaatgtaggaaatttttaggcagatctgagacctatattcttagttatttcaagtacctctgctttctgggagtgtttctgatattgacattttaatattttctggatagacctattgtagtttaatagggtgtgtccataacccaacagccatcctccaatatatgtcttccagtggttaattagagaaaataagttataaagatttacatggtggttgtattcttttcacatctagtatcccaatggaatcttgtgtttaggtacacttttactggaatatatacttttgaatcacttgtaaaaatccttgcaagaggcttctgtgtaggagaattcacttttcttcgtgacccgtggaactggctggattttgtcgtcattgtttttgcgtaagtactttcagctttttgaaacggcaaatttatgaaaatctcaggcagcacagtgttccaataacagcaaacctctggggtctgatttttccagcatggaatgtctgtatttaaaggaaaatggaagctatatgaaagctagtcattgataggcaaatactaaatttttcaaaaagactatctcccactcagaggtatgtgacatcattgagattgatcatcttcctccatgctcagcacttggatggatagtctatgcagtgccaattaggtttacactttttccaagttcttgtttaaaaatgaataaaacctataagaagcacacaaaaaactcaggcctttaaatacaagtacagtgctctttatattaccctgtattattcaattattttatatttttgtattaaaatataaaagtatatatttgtaaaagagctgtcactgcttactaagcctaagattaatgcattgtatacacattatatatacactcagtttattttcaaggaaaatattacattacagtataattttaatttattcataattgttactcttttcccaaatgtatttatcagaaaaatggatttttacaatctcatatctagatattctattttccgttaatgactttgaattatcaaagtaatccaggttcactggagccacctagacaatacagaagggtcttaagattcctaatatccgattccttcatccctgcctaacctcttttccatcaggctccctccttttgaggtcacatatgatggggcagttccatctgctacctgctgctaagaaaacattgtgcaaagaagactgcctcttctcataggtctcctttttttcctattggtacaattcaaatactacaaaattcacaattttaaagtatacaattcagtgtttttcagtatattgacaaacttgcgcaacatcaccactacctaattagagaagtttaacaaccccaaatagaaactctgtactcattagcagtcacttcaatttccttctctccctggccccttggaaaccactcatctatgttttatctctatggatttgtctatttggatttttttatgaatggaaatatcaaacagtatgcagccttttgtgtctgacacttagcatactattttcaatgttttataaaaaattaaaagtctaaattaccataatgttaagggtccaacaattgaaacatttagttgtttacgcatttaagtgtatgaatccaatttaataatatataatatctgtattttgtttgcatcaaatgagtcaaatcaatgctaattaaattaagttagttatgatagcaaaaaagacttgcagaactatacatttaaaatagaagccccaaacgtagaaaataccttgactaaaggctcaggtaagtatcatagactctatctaaattctgaataattctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactatttgggagttgttctttgttcgtttgtgtgtgtgtcgtcactgtgtgtataaactcccctattacagatatgtgacagagtttgtggacctgggcaatgtctcagcattgagaacattcagagttctccgagcattgaaaacaatttcagtcattccaggtgagagtggggttaaacaccagggctgactttgatcttttgaaagaaagacataaaaaaaacctttctttatgcaattttaattaaatttgatttcttctgttttccacaatcattatcaaaagtcaacctttgagtttaatcaattgcatgggtctttaggatgaggatgactacttggctcacatctcaacttgaaatcttccctcctgtctgagggtttgtttttccatttgcttatacaggaaggaaaatttcaatccattttaattgattttaaaatacttaggaaagagatcataaatatcagcatggggatattgcatgacattgttttttattttttctcagcaaaccatttctttattgaaaattattacaaggtgtcactatatgctgtaatttgttttggtgccatttatagagaagtggtttgtttgacaaacattagaacttacaaaaattatttttaaagtggtttgaatagccaaattgttcattttgacaacctaggtattctttgagaatatgttcctatttttaaccatttgctgtaatatataaaaacaaagtatatataaaatagcaaacccagaaggctttttttgaattaggttacttaaggtcattgatttgatataatgcatgactttctaggaaagcttgtgttttttgtttcgattcagaggctttatgtcattacaaacacttttttctcccattttcaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaagtaagaatgtccttgcatttgttattaggttgaaataatgctaaaaacattgctctcttttaataatgaaatgttgctttcattttaatcatttcaaagctattcaaatatatagaaagctgctacagtgtgaatttgggtcatgttatatatgattttcataaatcatcctggttctaagctatctagcagtactggcaaaaggaacacaggatagttccataattcctaatttctatatcataaaaaagaattattttctctagagaaataaatgtagccttgaattaataacattaaccattacatttaacaatataatagattatatattttatataattttattatatagtacatacttatatttattatatataatgtgacatatttattatgatagatttttatacttaatagattgtactcataactataacatcttaaagttctattaatcatatataatgataatattaattatcaaatataaagatagtatctgtatcttgatagtattcctaaagatttgtacaaagcaaaatcatttgctcagctttatcaacatccactttgtaaccaatgacgagtttcatagctgtttttaatggcttccttcaatataggctgatggcaagatatcaaagtttagttcagtagaattatttctgtaggtaccacatgagatcatctgtatgcactctcagaagtctgcttaattcagaagtatcaattagagtttcttacataaagcatgaattgaatgttctctaaacaattatcccctagcatggtgtctctcactggaacggttgatgaatattggatgaagatatgatcaagattgtactttctgtctgacacctggaatgtatctatctgatggtgcccacgtgaatacataaatcttaatagataatttgacccaggtgtggtatggaagtcacgaaacctttcaaatatatgtgctgttgccaaaaggaaatgagggaggaaaggtcaggattctccttagataataaaaagtaatatacatcattttcttattttaccaaatgtgtcctttctcactcactgtgataaataaaatcaaataacacctagcccacatggtaaaagactataaataaaatgacagaaaaaaatagaagccttaacaagaaaactgaaagttttgaagtaaaatgtttagcatatatatttttactaccaccatttgatgaggaatttagcatattttccccttctttttatatttaccctcttttccagtttctgattgttacaaacatgatttgaaacttatttccaatggatggagaattttatttcttaatttatatgctgtaaaattaatatatctgatgagtaacttacatttaatattgtagattattttaccacacttatttaaacttaagttttctcactgggatctgtccttttattctgagtcttgctcctatttctgagtttatactgtgaatggttttcttaacctttgttaaaagaaaaattttcaacaaattaaatttagcagcttatttcagcaatgaaatagtatttattgctgaaataagataataataataatgatttaggcagcactcagaaccaagagaagttcggagagctcaactcagcaacatgagcaggagtatttatagacagaaaaagggagtgacgcacaaaaacagcttgattgcttatagcttgacatttgccttatgtggacattgtctgataaatcagcaggctgtggttggctgaagctcagctgctgtgattggctgagacagctacttgttacaagaatatactaatagattagaatgcaatttgtttacatatgaagttagattgcaattctctatgtacacagacagcctttaatcaaatttaatttaattcatcgctttctggaattgcttcatgtatttttttttttttttgctaaaaaataatacaaaaaaagaagaaaaaaaaagaaaccccgtctctactaaaaatacaaaaaattagccgggcatggtggtgggcgcctgtaattccagctactcaggaggctgaggcaggagaatcgcttgaactcgggaggcagaggttgcggtgagccgagatcgtgccattgcactccagcctgggcaacaagagcgaaactgtctcaaaaataaataaattaataaattaataataataatagagcccttgagttatgtgaattatctttatattatatttaaacatgaatgcatgacaattagctaataatgaatcttataccacaatcctgtcttccaaatctgtacattattctttattttcttctgaaatgtagttttagtgaagaggtgtttaaatcaagtctgaattttgcttctgtttcctatgtcatagaagccatttttgactgcataattgattcaaactttcatttattggtgcgtttattacatggtttccctgagctatagcaataaatgatagcctcagcccttgctttcacagagcttatcatctagtgggaatgaaaaaaaatgtttaagggggaacagacaaataaattaaaaatatctcaagttataataaatgccatgcaaaggaagtgagtctcaggtgctgagatatcaactagatgagaagacatctctgaggtgatggcatttaagctgagatctaaaagatagtaagaagccataaaatagtttaagtgtgggtgtgagtctatgtgtggggggtgctgcttcaattaggagaaatagcatgggcaaaggtcctgaataaagggagggtatgggtttaaagaatggaaaaacagcagcgtggtttggtaagagaaaggaagaatggcaacagagaaagtagcagaaaaaataggggtcatatcatgcaggacatttcagcccatgggaaggagtttgtattttattttaaatgcagtcatttttattgctgtctgtcttgtgcacaactgattgagcaagggtagatggtagatgggaataagaaaggtaagttgaaggttgcttctctcatctaggcaagagaaaataaaggtttcatctagagtgatggcagagaaatgaagagaaaaaagatgagctcaacatacaaagtctgtagagcttgctgatggattaaagaagacaggaagcattgaggatgacttctcagtttctggctgcaataactggatgggtggtgatggttaatgaggaaatggtggacacatttgtagaggaaggtcactattagctagctaaaattaaaatgagatgcctttgagatgtccaggtggatatataatatagagaattggagatttaagtatagaaatcagagggcctgctgagtttggagataaattccagagcaatcagcaaaaagaaaggacacacacacctctacctctgaacatccctgatatttttaagtagatagagaatgggaaacctggtatttaaagcaatctggtaccaagatctacaactctgacatttagaattcaggtagaaaagaggacccagaaaagaacacagagaaagagccgccaataaagtaagaagcaaagatataaataatgaagccaagagaagaaaacatattgtagaaacagatgtgcttgtgtagaatcatgctgcaagatcaaggagtaaggatgatgaagaaagaaatatgcattaggttaagtaacagggaagtcatcagagaatttcttgagaaaatttgggtaagtggtagggttcaaggtaagaataaggtgcatacaggggtgaaaagaagaggtcagaaagaaggtaatatgtgtagacaattctcccaagaaatttggctataaagggaagcagaataatggggcaaatggctggcatttaaaaaaatatatgggtttttgtatggatgttttgctagtgataatgaatgagtagttatatatgaatcaattcaggagagagagggagaagtcaagtcctcgtgaaagtgaaagagtaaaggggagcgacagctccaccgaaacaggaggaaagatagaagagaagactgcagagttatcaaaagatgattgagttcaaacccaatggtttttatttcctcaaagtataagatgggatcattgcctgagagtgcaaatgaggaagagaaaattctacagatgatttgatgagaatgcattatatatatggtcatatcagggcatgagaaatttagtgtattttgagtgcaaatttgatgttggagattacttacttaaaatataaccattcacttggttgtgagagtttctccaccaacattcagccatttggtagccagcatggaaaagacagatgccagattatgtgtagactgtggttctgccaggttaggcactgatgataatgaatgcccatggatttaagctgtacaaagagtgacaagaacttggttgatagatcatgagaaagtgctaaggcaaatgaattggcaatatttaaaagatcaaggaattataatggtaaaggcaatctacacagagaacctgagcataatctaaaagcattttctggtgcctatagcaaagtattttccgaaatgcctttccaaattcacaatcaaataaattaacccactgtctcacctcctgctgaaaaacatacaatttgtagatttcctttggtgttgctgtctactttgatgctcatcaaacacttttttatgctgctacagatgaaagtggggttcatgtgcacagtgtgtagctaaatgtgcagtattatggagaaatatactgtggttatattgggctaaaacaggatattctcttcctcctgtttttctaatatttgacatttaatagagaaagttttgaaaaaaccgcaatattggccttcactactaacaggaattttcctatctccttcatctacagctgttttcttgtgagaactacatttgccagagtgtagagtatcatgtgcaggccctctgcccagtcctgatcccctgcactagttttctcagagttgcattatttgcccttcgttggggatatactcttcacttccataggcccaagccatacacaattgtcataagttgtctttctgagcaagggcagaattaccatttttttttctattttgctacattaatcttgaaaattaatttaaaaacttcacccagaatcttcattagatttaatatcaattctgtatttttgttatatcaattttcattttccccatacgtattttagtgataagttggcatttatttacccccacccacaacctttgccgttatgctgcattcccttttaaaaataggtttattgaggaataatttatatgccacaaaattcctttttttaaactgtataactcattttttaaactatactcagagttgtgcaacgatcgccactatctaatttaaaatattttcatctttcccaccaagaaacccagggcccgttagtagtcattccccatttcccttttctcccagcccctggcaaccactaatctactttctgtccctagggatttacccactctgtagatttaatatacatggaagcatataatatatggctttttgtatctggcttcttacacctagcataatgttttcaaaatttatccatggtatagtatgtatctatgcttcatttctttttattgctaaatgatatttcattgtatgtatatgctatattttgtttatacattcatcagttgatggacatttgggttatttccgtcttttggttataatgcataatgttgctgtaaacattcatgtacaagtttttgtggaaatacattttcaattttcagttctcagtatatacctagtagtgggattactgagtcatggttctttttttttttttttttttttttttttttttgagatggagtctcactctgtcgcctaggctggaatgcagtgtcgctatctcggctcactgtaagctccgcctcccgggttcacaccattctcctgcctcagcctgccaagtagctgggactacaggtgcccgccaccacgcccagctatttttttgtatttttagtagagacggggtttcattgtgttagccaggatggtctcgatctcctgacctcgtgatctgcccgcctcgacctcccaaagtgctggcattacaggcgtgagccactgcgcccggccgtgattcattctttatctttcagaatcatcccacttttgaatatgcacaagcaatatttcatttttctttgcattcaattttttcccatttttaaagatgttaaccttaaatcttcttgaagccaaccatcttaataatttaatgtctagttgtttagaaattattgtaaagttttctacaaacctagagtgagctacctgcattgctttacctttcatcattcttatactgtgttaaatacagtagtatagcagtgtgctaatagacagctccagagcccattcatataattcagctcctcagtggttgataaatgtgaaccagcattagtttaaaggataattctaaagtaatccatccttattaaaatattttggatgtttatgtatgcaaaattgcatcttatcctctcccatactcactctaccaggcccatccttcccgaggttcaggagtgttttcaggaaagcttttcatgcacattttcacctacatttgcacctcaaactgcaaggctttattgttttatctgtgtcttctaagtaagataaaatgatgatgtgtaattcaatcaatagttttatctcaaattgtataatagtttaactaattataataactcctgtttttgagcagctagtacagaatgtgtggatcacagtatcaagtggtttacatgcaatatcctatttatactatttaacaactttataaagtaggtattcttatacgtattttacagatgcagcagctaaggcttaatggcttaaagataattcacttacttaagaagggatagaagcaacattcaaatccaagaatatctgatttcatagtctttcttccatgattactccaaaagtctcccaataatcagattttttaatttgacctgagtaaaataggaagtcaggttcttatagtagaatagatatttaagagagatgacaaaaggttttttagtcatttaaacatttactatacaaggatagatctgcccccagtcttaggaacaagccttaacagcaaatgacagaagagttgatgagaacttttactactaaaaattagcacaaagaataccatgaaaggtgaaacatggaaaatctgcattgattacattgtcatctcctcaacacctagaattagtaggtcctaagtaagtatggactggtgaatgaaaagtaagataattttagaaaacaaattttactcacttatgttactgccttactgagtctgcctcttccggagtattgtaccacataaggatgttttagtcaatagcggaccatatatataatggtgatctcataagattataatactgtatttttttactgtaccttttctgtctttagatacacactttccattgtataacagttgcctacaatattgagtacagtagcccactctacaggtttgcagcccaggagcaataggctataccacatagcctaggtgtatggtagcctataccatctaggtttgtataagtgcaccctaggatgtttgcacaaggacgaaacgtcctaatgatgcatttctcagaatgtatcacagtcattaagtgacacatgaccgtacctttaatcatacttaaaatccaaactcatttctatgatatgcaaattccgacatgatccggcccctgcctacctctgccatcacaatcctccctctcaccacactgtagccacactggccatcttgctggcttttccacacaccaacttcatctctgccttagggctttagttctttctcttcccccagcccaaatatctcttcaccagtattttcatggctgtcttctttgtcacacttaggtcttagtttaaatatcatctccttagaaagaccgtccctgactgcagcctaccacgttgccttaatttattttctttagatcatttatcactatctgaaaatatcttgtatatttatttatttacttaaatttttatccaaccacaacctccaccctcacctaaacataaaggaggtctcataaaactaatgattttatttatcgtgtttattgtcatgtttattgcctagcctctaagagattatcaataaatatttgagggagaatatatgagaaaatagtaaataaatggatgcatattgcctgggaccaggcctgaatttgtagataaatgtctatatcaattaatttacctcctttatcacaatcacagattaaagtctgtgatgttataactgttcaaattcttcttcaacagaatatttttattacttggaaggatccaaagatgctctcctttgtggtttcagcacagattcagggtatgtaatatttgttttctttttagtctaaaggctgaaagagaaggaaaagaatgttcagtcagtttgcaaattagtctttgattctatattgctttttatatatttcatggtattatttgactcattctgtcccacagcaaatccagtctttaaaatgttcacagttaatgcatactcttgaaagcaagactttgagacagtgctcgaattaacacaagacagaagtcatataaatcttaagaaggtagaaaatgttacttctagaaaactccaccaaaagttggttggataatttcaggtcttctttctggaaaacgaagagtcacaaagtctatttttctttctactcccaagttccactcattctccaattaaatgtgactcataggtgactgaatgtcatgttttggccactctaagcaaagggattccttggacttgggtacacatattttaagaatattgtatatataagaatattgtatatattcaactgtccatcttgctgcttctctcttacaccaacttcattttgtagcatcagctgcataagctcttgcttttccccctatgcagacatctattcatcaggctctgtgtacactggcaacataggaataaactggataaggttgctgttcccagaagaatctcagaatattgtatttatttaatggcatcaggaaaaaccagtccaccaattttagaaagaaaaaagtcttaaagctgcacatttttatgaacttagacaattactatattttgactattattgactctaatctattccaagaattatacagacagaaagagctttggtaacagcctacatatcaatatttactgaaccaagaactatcacaaaacgtctgttgaaaatttccatgttttaatgatgatgatgctaatggcagctatgatttattaaacactttctatgtgcaggatgtaagctaagtaatttgtacacattatcttatttaaacttattacaagtcttattttcttgaggtagatgttattatcctattttcacagacagacttatgccttgaagaatttggtaaagtcactaagtagtcagtagccaaatcatgtattcttaatccttattcaatattgtccccctatagaagaaaccttgagtttgtaacttttcagtaaggctatttagcttgtgtcctgaagacactctcacctataatgttctttctcgtgtgtagtcagtgtccagaggggtacacctgtgtgaaaattggcagaaaccctgattatggctacacgagctttgacactttcagctgggccttcttagccttgtttaggctaatgacccaagattactgggaaaacctttaccaacaggtgagtaccaagagaaacatgcattgtatttttgaatggcatatgtacctggtgtatgttaagagcctgtattaggaggttttttatttatttgagaatggaggaaactctattatcttattaccaaaattataagtgttttactcccatcactaataatatgggtagttctcgaatcataaataattttcttatcttttctgggcatatttaatctctagatctctcgccttcctgagtatatcatcccatggggtcctagttaagtaccaggacatactgtaatgttttctcaagctgctcctgcacatggactgttttccatgcgtgcttgggatggcctgaagagaagaggctctctgatgttcacctgctcaccatgttttatttttgaactcctatttaaagttaaagatgcaattcatttctctaagtttttctctcccaaatcaattgctcccaactgtagacttccatgattttttgtattttcttccatttatatcattgatctcttgtattgcaagtggtaattcatgtggctatttcctctaacttgaatgtgaacctcttggggctgtggtctccatttacttgtatagtctcagcagccaagccaaaaggaaggagaccaaaatgattattctatagtacacataacaatgattcacttttctcagaatagctgcagatctgtttttttttcttttttggcctattttatatttactttatttccgagaatattataaatgaattcggaaattatgtaagatgcactttacagcaaaaatgggaatgcaaatattttttaaatatgcaagaagtggtcacctttactcaaaattaaagaaacacaaataaaaaaattaaaataatttttcatcagaggtaagacttatttttcatttaatatcagttgatactatcctaaattcactttaaaatgctttgtatgataaaagtatattacattatacaattattaatagaaatgttaattatcttataaatttgtttaagttacttgtagattcttaatattagacctttgtcagatgggtagattgccaaatttttctcccattctatagtttgcctgttcactctgatgttagtttcttttgctgtgcagaagctctttagtttagttatatcccatttgtcaattttggctttggttgcaattgcttttggtatttttgtcatgaagtctttgcccatgcctatttcctgaatggtgttgcctaggttttcttctagggttttcatggtttggggttttacattaagtctttaatccatcttgagttaatttttgtataaggtgtaaggaaggagcccagtttcagttttctgcatatggctagccagcttccccagcaccatttattatatagggaatcctttccacattgcttgtttttgtcaggtttgtcgaagatcagatgcttgtagaagtgtggtgttatttctgaggtctctattctattccattggcctatatgtctgtttgggtaccactaccatgctgttttggttactgtaacctcatagtatagtttgaagtcaggtaggctgatgcctccagctttgttctttttgcttagaattgtctttgctatatgtgctctttcctggtttcatatgaaatttaaagtagttttctaattctgtgaagatgtcaatggtaatttgatgggactagcattgaatctataaattactttcggcagtatggccatttacatgacattgattcttcctatccatgagtatggaatgtttttccatttgtttgtgtcctctcttgtttccttgagtagtggcttgtagttcttgaagaggtctttcatatcctttgtaagctgtattcctaggtattttattctctttatagcaattgcaaatgggagtttattcatgatttggctctctgcttgtctattgttggtgtataggaatgcctgtgatttttgcacattgattttgtatcctgataccttgctgaagttgcttatcagtttaaagagttttggggctgagatgatcgggttttctaaatatagaatcatgtcatttgcagagacaatttgacttccggtcttcctatttgaataccctttatttctttctcttgtctgattgccctggccagaaattccaacactatattgaatagcagtggtgagagagggcatccttgtcttgtgccagtttttaaagggaatgcttccagctttttcccattcagtatgatattggctatggagttttcataaatagctcttattattttgagatatgttccatcaatacctagtttattgatagtttttaacatgaatggatgttgcattttattgaagaccttctctgcatctattgagataatcatgtggtttttgtcattggttctgtttatgtgatggattacatttattgatttgcatatattgaaccagccttgcatcccatcaaaaagtgggcaaaggatatgaacagagacttctcaaaagaagacatttatgcggccaaaaaacatgaaaaaaagctcaacatcagtgatcattaagaaacgcaaatcaaaaccacaatgagataccatctcaagtcagtcagaatggtgattattaaaaagttgagaaacaatagattctggtgaggctatgaagaaatagtagcacttttacactgttggtgggagtgtaaattagttcaacaattttgaagacagtgaggcaattccttaaggacctagaaccagaaataccatttgacctagcaatcccattactgggtatataccgaaacgaatataaatcattctactacaaagacacatgcacacatatgtttattgcagtactatttacaatagcaaagagatggaatcaactcaaatgcccatcaatgttaaattgtataaagaaaatgtggtacatatacaccatggaatactatgcagccattaaaaaagaatgagatcatgtcctttacagggacatggatgaagctggaagccatcatcctcagcaaactaatacaggaagagaaaaccaaacactgcatgttctcactcataagtgggagttgaacaatttgaacacatggacacagggaggggaacaacacacaccggggcctgttggggggtgggaggcaaggggagggagaacgttaggacaactacctaatgcatgcaggtcttaaaacctagataatgggttgataggtggagcaaaccaccatagcacatgtatacctgtgtaaccaacctgcatgttcttcacatgtatcccataacttaaacatatgaaaaaaagctcatcatcactggccattagagaaatgcaattcaaaaccacaatgagataccatctcatgccagttagaatggtgataattaaaaagtcagaaaataacagatgctggagaaaatgtggagaaataggaatgcttttaaactgttggtaggagtgtaaattagttcaaccagtgtggaagacagtgacccagcaatcccattactgggtatatacccaaaagattacatatcattctatggtaaagacacatgcacacatatgtttattgtggcactattcacaatagcaaagactgggaaccaacccaaatgcccatcaatgatagactggataaagaaaatgtggcacatatacaccatggaatactatgcagccataaaaaagaataagttcatgtcctttgcagggacatggatgaagctagaaaccatcattctcagcaaactaaaacaggaacagaaaaccaaacaacgcatgttctcactcatgagtgagaggtgggcaatgagaacacatgggcaatgagaagatcatcacacactggggcctgtcggtggtggggggcaaagggaggaatagcattaggagacatacctaatgtaggtaacaggttgatgggtgcagcaaaccaccatggcacgtgtctacccatgtaacaaacctgcacgttatgccaaaaaaaagaaaaaaagaaaaaaaaatctctgtaccttcagtttaattttcctctaatcctaaaactattttgaaaaaaaattctattttaaaaagcaaagaaagcgaaaaaaaaagttaattgaaaatacctatgagatgaataaagtaattaaataagaccatctgcctagtgttaacattcaatgatattattaatatttgatgataaagaaagaaaagatagaattttaacagtaaaagggactatggatatcacctgttcctaaaatttgaaagtgagcaaaggatttaattttatgagtaattttcagactgtaggaaaaaatgcatgatttttatactactacacttaataatcaagaatcttacatgactttagtacaagcatattacattgctatattcttcgtactgaaaatgtgtttaatatttgttttccatgaagatataacttttctctttatatttttgataacatgagattataccaaactgtcagatttgctcatgcctgtcaaattgaaataatttactaaaaaaactttttattgttcaaatgacaatttccatttttccctagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggtactgttatttgatttaaaattcttcctagaggtagaaatgcaaacggttacaacagaggctctgcggtatatgcttggccttctccagctagattttctttaatgaatttttgtgtataaactgtatcctcatttctggtgtggaaaaaggaaccaattctgggctgagctagaattgatactttccccataatcatctcactgcatgaaaagtgatctaaggctgttcctcttaaaccttttacctacaatgacttagtgtgtgtgtgtgtatgtctatatatacatacacatatacatataaatgtgtgtgtatatatatatatatatatatatatataaacacatggaactatgtgtttttttaaattattatatcatgaggaaaaatcttttagaataattgattaaataatatagtcagatatataatatatatataatctcaatttatatatatatacaatatatatatgtatatatatacacacatacacacaatggatttccccagagtaccaattgtatacagtggtttcatgaaaattattttaacgttaaaattaacagatactcttctatggggtatgactaaaacagtgcatcatgttttgttaatgtcacaaggatttttaagataaaacatgagatattaagaaaataattttggtgtggctaatttaggttgtcatagattctcgaaagtttcctccttaatcctctttccagagagattcttcagtgtaaatgtttgagaaggcttgtactaagagaaacataatttcaaatgtactgcagttgccttaacatttgtctgaaggtttcacctagttaaatctcttcaaggagtctaatgtattaggggagggcaatcatctgcaatgcagataaattctgatgcacaaatattcagtgcagcattttaataatggtaaaaatcagaaaaaatttaaattttggaaaattagaaaataactaagaaaattatgaaaattgtatatcttaaagtattattttgccatagaactatgtgtttttttaaaattattttatcatgaggaaaaatcttttagaataatgatggattaaataatatagtccgatacaatctcaattttaaaattatacatacatataaaaagaatggaagaaatattagcaccaattatttctgggaggtaagatgactttttttctgtttttcatttatatctttatttcccatgtttttacaagaattttttagtgtttataaacaaaacattttgtaaagggatagtactaggttatcccaggtactacctagggaattcccagaagtttcatttaggccaatagtcattgaccttaccactttcttacaatattatgctttaataattcatttatttttcaaataactcaatctttattaaaccatagagtgcctgattctattgatgatatggagttaattgcctgataatcaaattgtctgtcttattgcatggtttatgcgagttttacattccaaaattaccttgtaaaactttaacatataatatttaatttgtctttactgtaagcaaattaataacatgtaatagtttaattctaaaatacaatagagctttatttcaacctgagacaaaaaccaaatatatactttgtaagcattctgatcattgtgtaaagaaaacgatcatttcatgtttaaaggacatgattatatgcaccatgttgttatgctaataggtgaaagatgtcctgtcctagggtttcctaggatttggaaatgactcatttaagtgttaacgtcttggcccaaccaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcaggtaccacccaaattgctaaatgtgtatcacccgaggcagaatgctagagaaaaatgtcttattttagggtaagagaactcgggagaggatagtgagtgatttcattggtatgattttaggtaaaaacctagtatcgctaggcatttatggaaagatgtacacaggtttccatttgggttcaatcatttttgaaagaccttatagtttcagaattgtcaatatattctctaataaactaattttcagaagcaaaatgttcctgagaaccattgtagaaataaagagaccattcacactatagaataacttttatatttgtatttagtctgtgttttgtaatgcttcattggttaaaaactaatcttagactagtttctcttctttcttaaacagtataggtaatagtatcactcacccatttggaactttggagaagcctttgatatcctccacccccaaccacatcaactactaatatgtagtgccatagtctgttaattctgtttatgtggaagttctctttccctttctcttttcactgaaaccttcatctctcaggcctccctgcttataattctgcacaaatccccaagatgaaccattgcttctgttttccttaggtcttccctgttttccatcacacaaccccacaaatcacttttctaaactaaaaatctagttaaaaatctacaagattctcctgatatacacagtaaaaaaagatagagtccctgccttcaaaatttcacttgaacctaggtgatgatacagaacttggacacatatatcaataaaaataaatatgacaggagcagtccaagctggttttgaggcaaagaccttaccatactttttccattgttcacaatagttgccactttgttctttacatagtaagcactaatgtctattgaactagatccttccaaaggatttacaccctggacatgagtcatataagcatgaattgaatttttcctcctctttggtattgggcaacttctttttaaatatttaatgactttataaattaactggtgctaaaagctctctttaaatacactttaactgagctcttagtatgtaaggtggattttcaatgcaaagaaccatacagcatgatttccaatttttttgtgaagcctggggattgatatataaaaagttgaatgaccagtagcaatactaagttctttttttaagttataagttctgtgcagcaaaatgaatggcattaaaagaatggagcagtaactctaggccagaatattagagagctgtatagcaacaaataatttacctggtcctgaaaggatgaattctacaaattgtttcatcccttaagtggaagaagttttcttctcactgaattgcttcgtttttaagtatgtttcttttaagtcagtacagagccacctgccctcaggccagtgggttcagtggtatttatatgaagtgtacttctatcagtaggtgcttcagcaaccacgttttttttaatttttctgcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcgtaaggacgttttacatagctcaggcatggctgggcccttgttcctgcatcagtcagtctctctgctgaagggccttctctggtcttgtgaatggctctgcattttgcaatactttttctataggaacacacctttgattcattagcctaatcctcattctatgtgttgtaggcatctaactcaaagataaaatcccatttttgtaaaaaggtacttgtctattaattttataattgaagattataaataatctctttagagaacaatttatgacggatacatatatagatagatatcagtacagaaaatgcaaggataatgctgatattagttaataatagatcccatttctatgaagaaatttggattacttgccagctactgctatctttttcaggtcacagcttaatatgtacctattccaaggaatcttatttgagttgttaataacagcaaacacatatttagtatttatgacaaccccatgagatgatacattattatctctgttttacaaatgggaaaattgaggcatggggaaatgaagcaacttgccccaatttactcagctaataaatggtagctcctaagttgaaacggaggctgtctgtttcagatcttgtgctcttaaccactcactctgctatctctccaatgtgcagtaggcttcttatcttgaaaaaatttagaatggctatgtattaggtcctccatataaatgaaacataactgttttcatttttaaaaaatatttcatctggagtctatgaatcaaaacaaaatatctgaaatgcaagcattgacacaaacaaacataaaagcaaaacaatcattttacagcagttccaaaggtctacgagtcactaagtggttagagaaaggtgtctgattaggcttgaaagtgagatctttctcattcctggagtttccaggatatctctttagcccactcactatgctatgctgcattaccaatatcagcaagggctttgactaacccaataagcttcaaacatatgctacatgcttatatatttatatttgcagacaatgtagtatttcaagtgagagtaaagttccatcaaatccatggccacacatatatttcaatttgaataaatgcatgtgcttttaggtaacatgtgacctctatgtgtgcatgatacagcttaagcccttctgcaaggtatttttcattattgaatgagcatgttaaatttctgtggaatcaaactttgcttgcattttgttttgcaattatgtgtgtaatatgtaaaatactatataatttatatcagattaggagattatttcatatttttaatgaagtttcttcatttaagagttttttcaccatagaaaaatcagtatcacaataaatcctaaagtgaaaactacaaaactagaggaattagtggatacttataagatacaatggaaatacagtaaacataaaattgtggcacaatatatggtttatatgaaaacactgcataactaataacgtcatctctatacctgaaacatgtctacatggaaaataatttgtttaatctgacaaattcttgtttgacagactatagcacagaaaacctggttttcgagacttttcaaaaagttgactttttacagagatctctcaaatgggtgtgtctgttcacatacacatagatgcataatacacccatgcacatatctatgcctgtatgtctgtgttttgatacacatacatgcatgactatacctatacaactatacaactttacaaatctagaaatatatatttaaaatatataccacataccacacacaagcagacaaacatgatagatctagagttgtatagttgtttgtgtatatatgtgtgtgtgagtgtgtgtgtgtatttctggcctgcatggaaccaacatagtgttttaaatttgaattagtttccaagttttaaaaataagacattttctcacaaaaataaatacacttgttatgcatgagttcatgtttttgcatggcaacaatttctagagctgaagagaggtcacctctttcagatgtagcttgcattctccatttcactaattgttcctttcaaactgagtcatttatcatcatatgctctgctcagttcatgaggtcttccttggcagtaagagacaaccattacaggagcttcattaatgttgttccctcaataaaaagtaattccagaaatttatcagagaatactgagattctacccctttagatacacagcactacagcactttcactgttttcatgtaggactgtcacatgacaaactatctgaataaattgaacactcagaaaggcagagaggtgatgatagtgatgatataacaaaaaagcagctagctttattttttatctcataaatattaattcctttaatcctcacaagaatatgaagcaagcactatgattatccccattttaccaatataaaactgagacagttaagtagctctcctatgatatacagccagtaagtagcagagccataatttgaacccagcaatctaggctctacttttaattactcactacagctatataagcaagattttatcttatacctacaatttattaggattctgttcttaagacattaattgattttttttttagggcacgaccaatcaaatacacaagaaaaggcgttgtagttcctatctcctttcagaggatatgctgaatgatcccaacctcagacagagagcaatgagtagagcaagcatattaacaaacactgtggaaggtatgtaataatcttcttttactgtacagattcttaaataaaattaacataaatctggtcaaccttaaataggcacatgaaattcttaggaagaattcagagaccataaaatggttttaaatgatggtaaagataaccaatggatactgatggaattgtttttatgtgcttaaaaatggataaaattatttgctattaaacacagacattgataacatggcaaaaatgactttgcaaaatgaaaaaaagaaaacccacaaagacagatgttgggtgatctgacctttcaaagataagtgatttaatagtaattgatgcagaaaacaaggttaacccagagctacgtgattctgtcactatataatcttacaaattacatattcgctcaaaaattgtctcttctaataagcaaagatagtcaaagggtgacaactttacaaactgtgctggcttctaccctctcccctgacaatatgccccaggtcccacctggtccctgggtctaacacttcaccccccacattcccattgtgggggcaaagtgtctactcatctcctaaataaatggtgagaagtaaatgggctaatggtgtgaaatgtctatttcatgagtcctccataaattatttctagttgcttggttctaggattgttttcacctgtgaactattacagcaagagttttttctggacagaatagtctcatcttattgttgtcatgggactaaaaacacaggtgaaaaatatgcatattggtggaaaacatacatttctctgttaaggaaacatagttctcctgtttaccatcacatgttaggtgcatttttctctgaaagatgcccacatatgtgcttgcagtcataaatttcacttccttaccctctcttatgcttcatctaggcaacgaacatgtcataatagacttacataagaggctatgctttcattgaaatagtactgttaaattttcaaaatctaaactataaaccttgtttcaatattagaatgcctgactgatttgtatctggttaggagtgaaacagacaaatggctgactccatgttctctgcttttttctcccagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtaagtctcttattgtgtgttatgtactcatagtttctctttttagttgtcatcattgtcatttcatattttttatgtcagatgaatctgcagcctcagaattatgcatatccagaactttccatatgaatggatgtgtagagtcaagtttctggttatgtcttttaaaataattgtgcagtactgttgaggtctacaaataacaatactatttctataaaaggttaccatcttgggagttgataatgattttttctgccagcatatttcttgggagcaacacttaacatttttggttctttctcacaccttcctaattacattgctgctttcttgtaagtacacacctcacatattttcagaaaacctatggatgtattgctttgacataatagtagtgaagtgtttgggtcctcagagtcccaaagtcctgggtttgaatgctgattctgcattatatgagtgatatgcccttggacaaatattttaactctgtagtatttaattttatcatttataaaataatacttcattataaaataattatttataatataattgtaactgtatttcatttatcatattcttgggaggattaaatgctttctgcttattagcctggcatatagtaaatacacaataaattaaagctatcatcatcatcaacatcattgtcatcaaaacttcaaagacttaatgaaacaagctttaaaaacaactattttgagaaaccaaaatggttgaactggacatagaagactcaaggataggcaagaaggtgatcaacagacttctggaagatataagatccaattagtaaaattgatgccagagtgatctctaaaatgtacagtgctggtcacactaactcagggtaaacaaaatgccagtttttgactatggatgtgaggcaggcaccagttcatttttagggccagagaatctcagcttatgactcttcataaaccatgaataactttgggtatctttgtcaatgtctatataagataattttgcttttgctgtggtcccaaacaaattgacatttgaagaccagaagttcttttctgagtctgtcttttcttctaaattgtctacaaatattcccaatgtttttccccatgtgctcgctgagttagcattcttcttcccttctatttatctttggaaaaaggcaggaatatctagtttctaattgttggtggagatccggatcttgcaaataagtaccttctcactgagacgactgcatccctgtgaactcagaaaggatttacctggtcacagctattaccacaacctcaagtccagctgctccctgccaatcttcttgatcctgcattatttgaaaattgactcctgcagttatagacctaaacatttcccttagaatcttctttggtcagattccttgagtcaaagtgtacccaaaggattcatttcggtgttgcctttttaagtgagtcctttgataccagtatcatgaattaatgatattttgcaatgcacttttgtgtcaaagctttagaagtattactttagctgccacattgtcaattaaatacttttttctcttctgctgataaatctttaaagagtgagtcaacatgttctttattactctaacagtagtcagatcagaaaaaaaaagactggctcaaaatttcagtatcaacttatgttttctttttatcttcttccagaacaactttttgacccacataaattctttgaaaatagtgactgtgtcaattaccaaatgttttactcttctgaaattttaatatgctattctaaaatgctgtctaaaaatgatgagcactgacaggacagttagagcttttcaaccttttgatgctgatatgggagccagggaagagcaatacctaatttacaggactaagttagataagaatatccatttataaagtatttagcaaactgtctggaacacagtaaatgctaagcaaacagtgattattatcattgtgttgatttcctgttttctaatattaacagaaaaacattatttttctcacttaggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactggtaaacataaactaaggttgccattatattctataataaaggggtatttctttggttttgcattatttttaaaaacttttgggaatttgaatcaaaaggcaagattatatcttgatatctagtaaaataaaatccattcattgacaaatgcacttaaagaactaaaaccacatgaatatttttacaatttttgaagacatgctcaattctaatttgaagtacacgctaatataatataaatattttctattaatatagtacaataatttatttcagagtaagaagcttgtggcttacagaatttcaatgattatatgttcataactttatgaatttggtaattaaagatcaaattgttatcccccaaaacaattgttgtctgatcttaacaatataaaaacaaataaagactttttaaagcacattcctctaatatgctagattttatctaagtgtcggcatgagaaaatgtatgaaagtattagaaagtagaattaaggataaattatcaattctaaaagaaaaatatcacaaattatgataagaggtttctatagcaatcctgaactaaaagtacatagtttcttcataatatgtgttgtaattttttgtggcaagtggaacaaaataacagagatattgaaaattgatgaaaatgaaaaataagaatattttagctggataataatgacaatattataggacttaaagtctgctttaccctttgaacaaaaatcaagattggaaacattgaaaagattttcatagtgattaacattaaactttatatttgcttttagctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtatgtaaccagatgttcatgcattttaatttctctgtggaaattattttgtgatgatgtgatctattatttttataattttataattaattatatctacaattattaattgcaaaagaatagtgataattttaatacaagaaagaacaggaaagagaacgaaattttgtattagttttcctagccaaataacccatatttatatttttcaaaatcactgcctattcattttaaggcaaaggtttctatctttttctctaattttgaaagtgatggcatatgctctcttgaagctatactagtaaataaaatataattaagttaataataacaaaaatgaagttaataatggaccaaggcaaatgaaaggactggtcccgcaccttatagccatgtgtaagactagcctctatagcaaggatcagcacctatgccccacagaccaaagccagtccaatgcctgttattgtgtggccctgggagctaagaatgatttttacatttttaagtggttaaaataatcaaaagaagaataaatgacacatgcacattatatgaaatgcaaattttagtgttcataaactttattcaaacataggaatgtcaattcatttacgtatcttctatgactgcttttacattacagtggcagaggtgaatagctgccatagaaatcgtatgcccaataaagtctaaaatatttatcatttggccctttacgaaaaagttttccagccactggcctatagcatcgcgtggacatagcaatctgcctactttttgaattagtgttttcttggcttgtactttttttttattttttttcttccttatactgattagtgaaaactttcaagcttacaagcaggagaaaattgggataaaatgctcttctatgagccactcatctcaattctcaaatctgccacgttgacttgtcacagttggtcagcttgacatcaaatctctcatcaggtatccagaaggtgggatatggtaacagccatatggtaagtgccttcacttcccactgagttgaaaaaaattactaaaatattgttgtccttgtaaccaccataaaaagaggattcagaagtcaggacagaaacttacattcatccagtcacacactaaatgatactgtgccagacatacacaaaggcatttatgcagcacaaattctagatttttactgcacaaaaaatatacatcctggattaccattctataattgttgatcaccctcaagttgtagtaataaataagcttcctagttttatatagccttacaaattccttccaatatggaatgaaatgcacattctctttgtttcttcttctctgttttgtatttataagctcctatagcaggatttgcttgtgtattttttttttttttgagatggaatctcgctttgttgcccaggctggagtgcaatgatgtgatctcggctcaccccaacctccacctcccaggttcaagcaattcttctgcctcagcctcctgagtagctgagattacaggtgcatgctaccgtgccagctaatttttgtatttttagtagagacaggttttcgtcatgttggccaggctggtctcgaactcctgacctcaggtgatccagcctccgtcgcctcccaaagtgctagaattacaggcgtgagctactgcgcccagctgtgcatttcttcttacaaaattttgacataaaatcgtgaaattgggaaaggtataacttgtgaaaacatgccacatcaaagccaataatcacaaataatttaaatgtttattatttattcaggcaaattcaaagggaaaggcattcccttggctctcaccacattttccactcaatattttttagtatcttctctgtgaaaagaaaggtatttaggtattgtttagataggaaggcattgtttaggtattatttagggtggaagaccaaaaccaattacccatggtctaatccttgtttttaagatgcttattagggcacagaaaagtggaacacaaaagttatcagacaaggaagaagtgatgagttctaccaataaggttaaataaaatgcttctgacacttaaagaaagagttctagattgagacttaagggaggtttttgaagtgggcctttgaacaatggataatataatatttgatcatggacactggtgtgagagttatgttttcctttgaaaggcaatatagatttatagtaaaaaacagaggggatatattggtgagtgtttcattcgtgtagaattagtgttaactaactcatattattattctttaattattaattcttggcaaagaaagtatacagaagaaaattcataaagttgataaccaactcttgactaatggaggaactaccaatatcatagaattaaaatttaaggaaaaaaatatattcctgatatagccttccacattagagttatatgctaaactggcttctctttttttatatttctctaatttattcttttgatcattttattgccagttaattgaaatggttaaggaccataggtttaggaaaacatttggaaaaataagttttagtcagctcgggtctatatcaggaaacttgcgaagaccattaatcaaaatgagactttgaatcaagtatacattttattaatatttcttctcttgtttaacatgataatacaaagatgatacaaatggactttattttgatttgtgatacccactaggttatagaaatattagagacttatgatttttgaaggaaagaaagttgtcacagcagctgttctcaacgaagtgagaaccgcatgagccactgcaccctgttaaaatggtttaacgcttgaacagattaaggagactaaagcagtaaaatggaccctcagatcttcaccaatattcctattaaaacaaatatacacaaacatgtatttcatagtgaaatatactttttcattgacaactattaaaccatttcagggatttttagcaattatcaaaattgttcactatgattcccagacctccgacctccagaattttctcctaaatcagacttattgagacacacaattttagcctgctgtctttacttacatctcagagaaattgttttaggtatgaccaaaatgagggatgagtaccttctcttcagttaggtcttacttcgatttttaaaacatgaggtagatgatttgggccatgaaaagacttacatcaaatgccaattcaatttccttttttgtttcctggataaaacaatgtttaaatataatttacaatttacatgtttcctgccctctgtgaacattttttttttttacaatgtggagttgacctgcacttctacttcagtgagaaaaaaaaataattaactcagaaataaaactttgcttcaagagaatagaaattgtcctgaccttttttgtaatctcttctagggcaaacataataggcaatgaagccagccaatcataatgccattattgcatgtgaatcaggttcaaggggcaggtccttttctgtgctttaaaagtcacattaagcagtattctagcacgcttcttggacagaatattttattacaggaactttgtaagtattatgtgttccatttgttagaacaagtgacatttatcttctggtaaagtgaacaaagatctttagcacaatagaaaatagtcacaattgttttgttctacctgtttctcacaggtaataaagagtaatgatagatgaatgctaggagagttttttgggttcataaaagagaacttgattaaggcactactgctacagaaatgaacttagaaatgatgtaatgataatggtgagggatcattctctctgctccccatggtaattcttcctgggtatggctgaccctctgctgctgagtctgcaggggctagtctagggatacagtgatgaggagtctaccctcgcctctgtctctctcatgtggtcttatccgtgtgtgaaaaggtgcagaaatcttcgttgctggtttgtattgtggcctatattcggaaaagtgtacttattttattttattttttatatttcctgtctccctatttctctaccccctctccccaccctgatataggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtggtaagaatgcttcatatactttgtgtttcatattaacaattagtatgaaatgaatgaaaatttcatatttctattgtcataagttcttcttaacattgcatgtagtgatggatagtttttgtgcgtgactttacacaacagcttcctgaagattcatctggtaaagttttcttactagttcttaataattgatttaatcttacttagctgtatgagaaagctcaaaggtatctttgagccttcccatgcttcatcccatgtttcctgtcagttgaaaagttacacagtctccctccacagtgcctgtttgaatccacctctccttttcatcacctttcctttgtactcactactttttgcctaaaccatttcaagcagagtctcaactgatgcctctgcttccattttgcatttactctagtttacttatttgattattttcgctcatgcagattcagtcctaatcatttcactctcatgatgtatccatgatccgcaaagtatcgctctctctctctctctcttcttttttttaaaaaacggagacaggtctcactctgttgcccagtctggagtacagtggtgctatcatagcttactgcaaccttgaactcctgggctcaagtgatcctcctgcctccacctcctgagttgctgggactacacacccatgccacaacacccagctaatttttttaaaaaagtttgtagagacaaggtttcactatgtttcccaggctggtctcaaactactggactcaggcaattcttcaaactttttccccagttgctgagattacaggagtgagccaccacgcctggccatccccaaagtctcgaattatgtactgtgcacaaagccttcacactatggccctaaccagctttgaccagctctatctcctagtgctcacccatagatttttacctgtaccaaaccaatttccttttaggtcataaacactctccacactttgcttgggatttccttctccagtcaaaatccttcaaggcatcacccttgtatttatcatctattaaattgttaatacttaaatcgcagttgggtcagggttaaatgaattaacacgttaatacatgtaaaatgtttagaaccatactcaatgttctcaaaatgttatttatttcatccctcctaatttctccccaaatggatgtagtcccttctcatttttgaaccgcaaacaattttatacttcttcctggattcagtaatcttaaattttaattttttgagaaattatggtatgcatcaaatagtactgtaaattcattgagaacaggaactctttaaaacctttttttgtgccctcctctcccacccttacctgcatatttctagtgagtcaaggtatgtattgagttttatttttattgtgaaatataacaaccgtattacaaattacttttatgagattgctttcaagtcttaaggcatcatttaaaaataatcttttgttttctctagctcatgttagaaagtatttgacagatatttaccaaatatcttctatctccttaacttactaagactccaccctccatgaatttatagtggacttggaaaacgagattatatggaataatcatgactgatatatatatatatatatatcagtaaaatgctcaggaggctgaggcatgagaatcacttgagctccagaggcggaggttgcagtaagccaagatcgcaccgctgcactccagcttggactacagagtgagactctgtctcaaaaaaaatcaatacataagattaaattaaatacataagattaaattaaattaaaacaaaataaaataaaatgctctatatttaattgagtgaataaatgattaaataaataaatcatgatatatgtttctatgtagccaaggacattttttccaagacggtaaagtaaggaatcaaatctagtcatccctcgatatctatgggcgagtagtttgaaggccccccacagagactaaaatctgcagatgctcaattcctttatataaaatggcacaatgtttaccataaaacctacacacatcctctcatatgtacactttaaattatcttcagattacttataatgtaaaagtaaatcactgacacaatgtaaatatttgttttactatattttttatttgtactatttttattgttgtatttttatatttattttttccaattattttccatctgtagttggttgactctacagatgtgggacccagggatacagaaggccagctgtattttatttgtatattttaaaatgttctacatggaagaagtaatactcccaaaattttaaaaccgtgttcatttcagcttaaagttagaaaatcagattccacgtatgccttttaaggagcaggcatctaggtttagtatcatatggaaagggaaactaactcagtcacctatttttttctaactaactctgtcacccatttaaagaagattaaaattataaactccaattgcctggcagacagttgctctcagaataaaacttggattctaggtgttaaagcacttcaggagctggggaaagtcaaccaaagacttctgaaattatttcttaacatttatgaggaattatttcttacctgttcatttttctttcatttaaagtcaatggctgacctttcatggatctccttagctgctgacaaaattcttattcttagtatgttgagttgcaacatttttaagggaaccttatagaactttccatttagcacttcattttctaactgaaaaagcagactcattaaaaggaagtgattttattcacagttataaagctagagttatacagttataaatctagagttatagagttatacagttataaaggcagagccatgtcaagagtcctaggcttgtgacttatagctcaatggaatttctacctctcttgtcctctctttgtccatttgaaacacaaaacaaacattcctattggacttaataatttgtctcccctggggtataaagccatgcagctatagaatttatatatctgtggcatgcagatgaaggtgtgttgtcataatggttagctatcttttataactagtgattttatttgtattttataactgaaatagattattttaaccattcataaaattactctgtcacttattccatgagcccttccgaaagcgtatgaaatctagtgccctataaactgagttgtctaaaaatcatttgatgttaatattctaatattcttgattttcactaatttttttctcattacataatggttatatctatatgataaaagagtgtacattcttactctattacatttccatggtatgcacaattaaatatacaggagtttgtggctaccttagaggttgtagtaacagatacacaagctagtatttttaagtcatgtagcatagtgtttgaattagcaagccattttaaaaaaagtgtttgttgtcatcgatttctgcatcattattattacttaagaactcaggttcttagtgctactgacttctaattatgaactttgaaagtttacccttcttcataaaaaattttccatgacgtatctcaaagtatgtcatattaagtatagacaaacctacctgaaaatataagaattgagaaataatgaaggttcaagatctagaggaaatttgtttgataagatattaagctgtggtcaactataaaaaccttacatctaaggtctttctttccagcctcttcagattaaaatgtttccagtttaaattctgtcatttttgttttgttttgttttcccattcagatcactaaaatagtgtacattttatttatttgtctaaaatgtctttaatcctcctatgctaacttttcctgctctaattctcataatcttcatctcccacttgagttcccagagtcttgaactgtgaattccctcttttgcaacttttatttttttcgtatctgagatgcctttgaaatagtgatggttgtgtttgtgatgagcctggatgagccaaagaggcaaattgaattacccaatagaaagtaactcctaatttatatatttatgtcattaagtcttagccactaccttgggatatagttaagaatgccactttttaagatagaatatttgcctcaaatcttagcttttgataagaccttgagcaatttacaaaaacatttttttcagtttatttatgtgtaaaatagattgtaataaagattatatgattctcataaataattagacaaatgcttattgaaaagtgctcaatgtacaattattataagtatggaattgagtgcttatatacacactgtaagtagctattggttacagattgaatttaaaagagatagcgtgatgaagatcagtgcttcagaattttagtgtgtgaaagacatacttggggactttattacaaatgcctgttctggatcatatcctttgaattgtttgcctaaatttggatgcaacttcagaatcattaacaacgtttgcagcagctactgatcaatagagactactatgaacaatcatactccaacaaattggaaaacctaatggaaattgataaattactcaacacatacaacttgccaagactgtatcatgaagaaatggaaaactcaaacagaccaataatgagtaacaagattgaatcagtaataaaatctctcctagcaaagaaaagtccaggaccacatggcttcactgatgaattctaccaaacatttaaagaagaactaatactaattcttcttaaattattccaaaaaaatcaaaaggaaaggaattcttctaaattcattctacaaggccaatattaccccaataccagaacaagacagggacacacacacacgaaaagaaagctgaaggccactatccctgatgaacacagatgcaaaatgccccaacaaaatactagcaactcaaatccaacagcctatcaaaaagattattcaccatgctcaactggaaatcgtcccagggatgcaaagatgtttcaacatttgcagaacaataaactttctatattatatcaacagaatgaaacataaaaaccatataatcatctcaatagacagagaaaaagcattttataaaatccagtatcctttatttgataaaaattatcaacaaattaagtatagaagaaacataccttaatgtaatgaaggccatatgtaacaaacccacagctaacatgatactaaccagggaagagctgaaagctttctctccaagatctggaacaagataaggatgcccactttcactacttttattcaacatagtaatgaagttctagccagagcaatcaggcaagagaaagaaataaaggacatttaaattggaaagaaggaagtcaaattctctttgtttttatatgatctgatcttagatatagagagttctaatgaccccatgaaaaaaagtagtagatttcataaatgaattcagtaatgttggaggacacaaaatcaacatgcaaaaatcaatattatttctatatgttaacaacaaataatctgaaaataagaaagcaatcccatttacaatagctacaaaaaataaaatacctagaaataaatttaaacaaggaggtgaaatatatttacaatgaaaactataaaatattggtgagagaaattgaagaggacacaaaaagggaaagatattccatgttcatggattagaataattattatttttaaaatgtccatattacccaaagcaatctacaggtttaatgcaatccctatcaaaataccagtgacattctttacagaaaaaaaaaaaaaaagtcctaacatttgtatgaaaccacaaaagaccctaaatagcccaagtaacctggaacaaaaagaacaaagctgatggcttcacactaactgacttcaaaacatactataaagctatagtaaccaaacagaatgatactgacataaaacagacacacagagcaatacataagaatagagagcccagaaataaatctacacatatacagtcaactgagttttgacaaggttccaagtacctataatagagaaaggacagcctctttagtaaatggttctgggcaaactgaatagccacatgcaaaagaatgaaattagacctttatctcttactttatacacaagtcaactcaaaatagactacttaaatgtaagactgaaaactacacaactattagagaagaaaaaaaacagggggaaagcttcatgatgttgttctaggcaaggatttttttggataaaacctaaaaagcacaggcaacaaaagcaaatatagacaaattggattatattaaactaaaaagcttctgcacagcaaggcaaacaatcaatagagtgaagagataacctacagaatgggaaaataaatttgtaaactatgcatctgataatgggttaatatctaaaacatacaaggaactcaaacaactcaacaacgacaaaaaaaacaaataattcaaaaatggacaaaagacctgaatagatatttctcaaaagaagacaaagaaatgccaacagataaatgaaaatatgctcaacatcactaatcaccagggaaatgcaaatcaaacctatcttgaggtatctcctcaccctagttaaaatggctaccatcaaaaaatcaaaagatataagtgtttaaaggatatggagaaaagggaatccttacacactgattgtgagaatgtaaattagtaccaccattatggaaagtaatatgggggttctttaaaaaattaaaaatagaattttcatatgatccagcagtcccaatactaagtaaatatccagatgaaatgaaatcagtatgttgaagagatacagtaaacatagaatactgtactcctatatgtttattgctgcactgttcacaatagccaagttatcatattaacctaaatgatcgtaaataaataaatgcataaagaaaatgtacataagaaaaattgaacgccattcagccataagaaataatgaaatcctgttatttgtggcaacatgaatgaacctggaggacattatgttaagtgaaatcagccaggcacagaaagtcaaatatctcacacatatgtggaatctaaagggttgtcatagaagtagatagtagaatagtggttatcggaggatgggaggcttggaggagcgaggtgtggggaaagattggtcaacaggtacaaagctacagtgagatagaaagaataagttctggtgttctattgaatcgttggatgactagagttaaccataatgtgttgtatatttcaaaatagctagaagtttttaaatggtctcctcacaaagaaatggtaaatgttcaaagctatggatctgctagttaccctatttgataattatataatgtatacatgtatcaaactatcacatgtaccccataaatatgtacaattattatgtgtcaataatttttaaaataaatgatgccaacttaatccctagcttacttggattcaggtttctgagatattattttctttattcaggggctatgggtatatttccccttttgcttgtttaagaacctgcattttgagcaaggggaaaaaacatcactgacctttgatatctctccctctcttctccctacccaaaaaccctctcttttatgacctagcatcctggtttctcaacagagtttatggagaattttcagtgctctcctagtataagttttcaggttgacagatttcctcaacctgatagacagttaaaaatacactccagaatcaaatcaaaatattttacagtaaaacctcttatcagaaaataaccaaagagatgagttaaaacaaacggtttagtcaaatatcttaaacagttctgaggaaacaaatggaaatagaacaatagcacttctctgaagagatagtcagtgtcagaatcaagaaagacatgctgttatctcaaaggtacccatgagaataatactcttttcactgtttctaagaatgcaggcactgaactgatggctcttctcagagtcagccttctcctgaagtgcaatgaagccctccaagcacactccaaacattaacaacacactacacaggcttttttaccactggcagtgaagtgcttcctcattagaagccttaaaggaagtatgaaatgcacccatttgtcaataaatatttattacaccttactatgctctaagcactgtgctaagaattgctgagggaaaaaagatcatgttctcacacagctgcaacaatttaatatcgggattaacttgaaagttaaaatataagggctcagggtctagatatataagattgtgagctgatccaaggatgtattagtttcttacggctgttgtaacaaattagcaaaactcagtggcttacaacaacagaaatttattcttttgccagttctggaggctagaagtctgaaatcaaggtctgagcaaggccatgatttctctaaaggctctagtaagtatcctgccttgctgctttctaactttggaggttgttggcaatccttgcagcttgcagctgcatcatcccaatctctggcccggtactcacgtagttttctccctgtgtgtctcggtcttttcttcttataaggaccccagttatattggatttggacccacacaatgacctcatcttcattgtgtctgcaaagaccatatttccaaataagatcacactcaaacatgccagggttaggacttcaacataacttttggaggattacaattcaacccacaacaaagaattttgacttagaagactagatggttattgatacaattaagaatacactgatggaggagaaaattgaggaggtaggggaaatacagagtttaatttggtggcatcataaatttgaactacttgcagtacaggcagtgaacctgaacaggaggtatatggaaagataaatcttaaggaaagaagaaaagtcagagttgtagataggttgggattttgtatgctaactttcattaatcacgggattgtgtaggggtcagttccctgggaaaccaatcctgagagagaaatctgagatttactgagaagtgttttcaggaacgaaacgtaacatctgtaaaaagtgaggcatgcaaaattattgggcagagagagaagttgaactgttaaaattgcaacagagatttcggctgatcctattggcatctctgatgctgtgacaaccctctggagtagttccaaaacaaagcaagagggtcaggcctttcttctccacaccattcattggatgcaggctctccctttacctttccaggggagaagggtataaccttgggggaagcacctcccttctgccacgataaggcccaaagagggattcagatgtgagccttcagcatccaacacttttggcagctgggggaatgagcagcttgctggaaagcaggatgtggacagtgccttagagcatctacttcatgacagaaccacagacagcagctgagaacagcggatcaaacacatttgagaggtggatgcaaaagaagaaagcacgcacacacacacggataaaatgtatacagtagcccctttacacacattatataattttcgtctttgtgacctccttaggaagtaaatataatgcatctatatttgcagatgactgcgattctaaaagattaagaaaagatttggttagtcatggacgtatctgggggtctttttaaatttaaaccccaagctgtaatcattatactacatgccatagaaaggcaagaaaatgagtagtagtataattgttttctgctatacctctgtaatggtgtaattcagggtgaaattttctgttgtaatggtattgtacatttgctgattcattgggattctgatattgtgcttctaatccaccttaatgctgactgattaggttatagtctaccttggtaataatgtgtgatttttatattttaggtgtttaaatttgtttcttcaaaactatcttattcccttctttattgaaaagtaaaactgattttacttctagaatatatttctttctcaagactacataaccctttcctttccatttattcagtattaaatgcatattttatacattatggtatttcatgtgtatctgtatatttatttttgcatatattaatgtgtctattttttcatgcaaattattgataaatatgacaaactcatctagaccaaattcaagttcttgtagcttctgcctgatacattcattcttctctaggtgaaaaccttgctgaggtaactatgaggttcttagtgctactaagacttatccagctctccctggcttgttgatgaaattggcaagtgactcagaaatatcactaaagtccagatcattgcctttaaagcatctcctttgtcatgacttattatgttattacagaaaagtattaaatcaatttggcataattttttctacacatcactttgctctctttgaacctttgtgttctctcaggacaatgtattaagtagaattgatttattattatattatctttcacattaaggctatattaggggctagggagtacacttactgccacaccaaggtacacatgttaagatcttaactatttgaataaacctattttacttaagggtacatgggtaatccctatttttttgtgtgtgtgttttgttatttttggctatttctgagtcaggactctgtttaactgcatgcaacagagacttaactacattggcataactggatagaacattctgttttcatattttaaaacatccacagatcagcagtccacgtggcctccatgtcctaggctccatctcttctcccttctgccaatcttcacatgtgttttttcttctatattaatgcctatgattagaggtgactgttccacctacagctttatatccaatacccaggtagagaaagaaatagaacgaagcagaagtaatgactatcccacttgcctgaggaagggcaaaactttcccagagatccttatccaactttggcttatgtcttattggcaagaacagtgtgacatggccacccctaacaacaaggtagcctggctgaggcaggacatttatctgggcatattgctaccctgaataaaatctggattctcttggtaagataccttggaaggtattaacaaggtcaggcatgcttctccaatattactactgctactaattattattattcctttatgaaaatgtcaaaagaattgaaggatggtaattttctattttaagagatgcagttactaggcataatttggaataatatgcatcaattgtaatgttatactttgaaacatattgtataaaattaccaaaaaacaaaagttaatttttacttattgaattagaaaatatatatgaaaataagaatattttaagttaaataataaaaaactaaatatccaaccatttttaatctgcaaaaactagaaatttcatgtggctcaacataatacaaaggcataagtaaaatataaacttcattctacctgtataatcttatttcttaattacataaatattatgttactgaacacagatattttattcatttcttttatttgtgcatagtagagaacacattaaaattttctatgactctctgcccagaattataataggcatagagtttttctctcctaaattacactcatgaaatatttttggccccctataaatattgagtcccccaaaaaccacactaaaaacttcatgtacttcaaaggtaaagggtgattgatcattgacaacaaaaagtatacactctaatagcttgcaccttaggtaaatatacaaaaaattataacacagaacaaagcaaagcacaatccgtaacaggacactaaactagtccattgaggatgcattgagtaaggggctgtatctggctgacttcacatgaaaggaggtggcacttagaccagaccttacagtatggagaaaatttcactgggcagatgtggtacagaaggaaatctcaggcagaggaacaagcattcatattgttcacctgattcactcattcattcatctatccacccattcatctattcagtgttcagtttacaaagtcattatctttggagatacttaaatatgcttattattatgaaatgtagtcattttgttgacctgataaaaagttgtttcaatatttgcagttcccaaattaaatatttaatgtccttttactatgtggtggttttaattacactgttatcaagactttctctctttagatttttaatcaaagttttagatttaccttctgcttattactacactttagaaaatataataatcttttaaaaatgcatttgactttgaaagatttagggattagttacagttatgctgtttcgtaaaattggcatttgattctatattttatgcatagattttttttaaaagcactcttctgtagaattgcacttagaccatttgtttttttcaggttgtttccaaagaatttgaaaaatctttccatcttcattggatttgtttacgtgcctaaaaacaatgaaatatttgtctgacatattcaaatcaatgtgtcttattctttatattttgataaatttggaaacttcacttttttgcaatgctgtttaaaatgtcaaaattaattaaataaaaataagtcaatcaagaaatgctaattttagaatatgctttttaaagctgcatactcttactgccacctcaccccctatactgagaatcacttatatttaaatgttgcttgcatttaaggaaaaatagaatgcaaaacattgcattagcacattatagtatttaaattcaatttttaaatagtagagtagaattatgtaactgtttaattgattgtttttaagtctctgttgaatgacatttaatcttagtactgtgattcaaatatattgcttaacgttgagtatatagcatgtactttcaaatatgtaactaatttctacttacaggtatatgactttaaacattttaaaacacagttgactaaactctttcatcatgctgcatttctaaaattcagtacctaaccttcttctcacaggggtaatatcaaactggatcagtcaaggatgcagctctgtgcttttaaccaggcagagacatatgtcaccacttttacacaggttacctaaaaaaatcatacatacgatattttttcaatgtcttgcatgctgttcagctacaaaacctttctgcctgacccactgcaagaaagtagaaacatatacagttgttcaatagataaagtgacatcacagcatgtcaccagggcaatttgattatttttttgtgattctcttgatgacttcttgatgtaaccttcatgtgcttaagtgatttcaagtgcatgatctgtagatttttattgaattgattataaaagtaaaatgcagaatgtaacagtagccattgaagctacatttaatttgaaaacctctatcaacttcccttcctgatttaatctacataaaaatatggagagatgtatatcacattaaattgtcacatttaaattaagtagatcaaaactctaaaaaattgtggaagaagtgtttctggcataaatataaaatctcagagcaggaaaagatcattgtaattctagctttgtatttaataattctggttatgtatttatggataagcaaattgagactcatgctttcttagtacacatctagaaagttggggtcaaagccaaagtaccctgcttctagtataaactttgaatacattttgaaatggttttatgcactgttagttatgggactttatttttttaaatcaactcagtaattaacatttgattttatttgctcctatataaaatgcatcagttaaaagttgataggccttgcctatgaatgaataagtgataagtgttcaaaatgtttaattttattccagaagtaatattactcattgataagaataagtttctgattatatacataatcagatcagtctctagaaactaagaggtttagatagagcatattataaatcctatctatcaataacacatagaacacttttactgaaattagatacagattaatatgtattgccttattgaatatttctaaaatgtattaaaatacatactaagatatattttaattttagcatactttgttgaatgactgaactttaatagttctaggatgggggcaggaatctctgccaataagaatcttgactcctttttataatctagttcatattttgaatttctctgtcattgttgagatgtttgtattattgttatctattgtgcaatgatgaaagcaaaactttatcctgaaattgacacaccttagagataatattgctaacagtttcaaatgaaaaattagttattttagtgttccagtttatttgaagataattttaaaggtggcctaagtaaaagatatatttttctatttcaaatttggtggggatttagaggcaatattctcatagaaaactattttattccagaatatggtgaattttcttcaactagagcctaaataaggatgcatatacacccaatattatctatataggtatagataaaacatataatttttgagaaagctatttctagaaatatatatacatgcatagacatataaacatatgcatatatatgttttgaattcataaattcttattacttttttaccaagctgttagaaaagatgaggtacatgttaatgaatggtcatcctcttaagaaaaaaactgaatattcagttaagaatgacttgaaatatggcactttagcaaaagctgcctacataaaggatatagttattttatccatgtaaaatttctatttatattttcaatattagaaatccacatgtttaaaaagctagtaattattccattcattaaaattcacttttccttgccctccttcattgtgggtagtattagtagttaacagaaatgattcagatatctaggtagcttactttgtgtttgtcattcttgtttgtttcaaaattatagataatatttacgaagcttgagtctgcgtatctacactttgcctttatgtttgctaaggttccaatccttctttacctacttgttgcatttttttaagctggcataaatagcaaaattgtttaaatgtttgcttctaaagactttaagacactctgacttgacccactgtattccagctgctttctctgcaaacagtgtagcagttctgtgacagagcacagagagagcccttgaatatcaatggccactttacactcctagctctttgcttctcttcttttcattagaaagatgcttcaagatgatactataggacctggctgagaaatctgtagccagtctagccttcttacatggccaactgttgttgcttttatatgatttctttatattcatatcttatcatttagtcacgtaagttttcatgttattggatagaaagtgccctaggtagaagattctgagaaaaagaagaggtctccgtgaaatcactggttttattctgaatttctctggtggtggctgagatttgacctcattatttcaccaacagaatactatatatcatgttgaccttgtgatggaactgtgtgtttcacgctgaataagtagctattcctcccagagcctacacaatatttctctgctagcaatagacaaagaaaaataggaaaggaaaaaaaattggttttcttgccctttttttaaaaaaagagctaaagttttagttgcccataattagaatgtgagcccagaatttattgcaactagttaataaactgacaattttctgctaaattagtggaagtaacattaaaacttagacaacagaagaaaatacagttgagttttccactgatcaataatatctggagtattttttaattatttccatttttttcctgaaattcctgagcttcagtgattttttaacttgaggcattaccttttaaaaagaatcttgagaaatttcatatcaaaaaaaaaagattgtagagacctcaaggggcccagaaatctaaatcatgttaagaaatgtgattacactcaagatgaaaagcactaatagtaatatcaataatattaatgacctccaattttaaaaactctataagaggataatgttcacatttctccagaaggaaaaaaataaaggccctgaatgattgcaagagagaagaaaggttatttttgttctacaccagaagagagtatttaaacatctagttgtcctgtaacataatgggaaacttggaaaatattggactcttatgccacatagtaactatgtgtggatttcttctcaaaggatcctttgatcctttaattgaaatttactattttactccttaatgattcaagaacacaattatagatattgaccgtaaaactacacaattaaattaaaagatggataatagtaacttgaaactaattttaaaatgtctttcttgcttattaacagataatggagcttagtttaccactgtctgccataatttttcttctcttttatacccatctcctccttttgatttgcttctctcaactttcttactgtcttttgtgagtattttaaggctcaggtgaaataaccattctaggctctgctccttaaagaatatctttttttttgttgtgtgaagcaaacagtttatagtatgtacttgaaatgtaacatttttcagttcttttcagcatcaatcattctctttgagtaaggtttttgttgagttctgtgttttgtacagtgctgctgtgtttgatagtttcttcttttgagcgttagattatcaagtcattagacactcctacctcacacctcttggaacaataaataactagcattaaccatcatccatgatagcatgaaataggcttacatcgttaatgtttatcttaggaaatgccagtgataaatttgtaagtgaacaacttaggacatgttctaatatgatacatatatttaacacaatttctactcaagcagtatagtagaaaacacagcttcaaggcaatcaaagggaaaaccatgaagaataataaagcttttaatttggacatattttcagtaattgaaaaggagcatcttaaatagctacataagtttacaatcaagataaggattgtttcacagctatagtgttgtatggatgcacactgaaaaatatggaaagatatgtctctctctctctctctctctctctcctctctctctttttctctctctcgattacctcaagggggttgaatcaaggagatagtggagggaacttttattttgcactgtaaatactattatacatttaaaatgtttgagtcaactatatcactttcatatttttaaaacacttttagaaggcacagtcaatatcatattattcaataaaaaggcaggaatgctaattatggtacacttctgattcctaatactagtgagtccaccttcttgatcctatgcttatatttatatttactttatttataactagactgccaatgatgaaaaaaattgatacttcccttttattagaaatcaaatccatgtgaaaattacagaaggtcctatttataatagcaaaagaaatttctttcatactaaagcatttatttcacttctctaatatagtcattctttcatttccaaaattacatggaaaactaaacaacagatgattgagtttaaagaaatgaagataatatagaaattaatcatataaaataatacaaataattgatatgatcttccttgtatagtaaaaaacatatattcaaagtacttaaatatggtgatgcctactgtgagaattcaatatatttcaccgcaggaaaaaaaaactttattatatatatcagcctttctatataaaggtattctcttagaaatctgctaaagaagcttatactgtagcaagtatagatttcaaaggctgaattgactagaactgtctatattgctaaagcatgcttataaacatttaattttatatacagtatggaaatagttactgtttgaatacttaatgcattcccaagaaaacattgaatgtctaagaatctattagccataataatttgtctgtaaatacaaattaattaataatagttcatgttaaatattttgataatttctgtcccattgaacaataatattgaataactttatgatgtaaaattctgtgccaagctgaattcaattgaccattaaaaaaacataaaacctgcatatgaaaaaaagtttcaacaacaagatacactatataaaatcacgtgaatttttacttgctcataatctaatttggcataaatctttgttaatgctctcttaaacagtgagaaaaccaattattgatgtttgaagatgctttcatgaatttagctaaagtcagaattctgcaaataagaatcattttatttaaaagttgttaccagctcagagaaaaaccattataactatttcctattgttaatattgtgtctaatagcaggggggtgctttgtattctttctatcagcaattcctctcactgctttacctcaaaacccaggccaataattcttttttcagaaatgaagggcctggtcttaacttcacagaataatagggccttgtctttcacttctctggtgatagttcacgtgcagccgagaggtcaggaattgaagccattaaaactgtagtcttctaaatatggtactttggattttgtggcaattggcacaaaatacatattagtaattataagtttatccaacatcgtttcctggattaatctgtattttaaaacttatatattttaaaactcattctatagtttatactttaaagcctattctatagttttatagaatattcagttataattaatttctattatcttattttaaattaaactaatttagatgaattcaatcagtttaaataacatgtttttgagtgaaattttgtactgatactttcataactgaaactgttatcaaactcctggacctggtgggaataatgcctctaggccaacatagattggaggagttctcttaataggttgttcataattatttactccagttataagaaagacattgtctgcttacatcattccttatgtacaatactttatccatgccatttttatgatgttgtatactaggtgataataatagcattgagaatttaatgtggtacccatcaagaatacttctagcttccaagtcaatctctaaaagtcaaacctttagattgggctatcatattaatacaaattcatagattgagaatcaatttatctgaaataagtattttattatttttagcacttgcacttgcttgaactactctaaaaaagataaagttgtaacttaataagagaattgtgttgtagtaactagtagctttcaatattcacatgtcatttagcaaatgagaatgaaaaattaactcttccattgatatgctgctttactcctttataaaacaatatttgggaaatttgacagagttttgctacagttgctgtatgtattttttgtaaagatttcttcgtgtgtgtgtgtgtatgtgtaaacatcatggttactcataaagctctgggtgagaaaaacctatttgcgttatgatcacttatatgatcataatgacaatgaattcattattccatgtgtaagtctgccatgtttaattttcttcgatctttgtttcagagtttgcatgtggtgcttactttagtagccactttcttgacattataaataatactgtttgatcttttctactatatactaaaatgttatatacaaaatgggtggtgttggtatggtcattggcattttgatttcaaaaccgtatttgattttgtggtcttgatcaaagaacttctatctatatcatcctgctacatatatttaaattcaagagataataaaaaatacatttggactttatcttgcacttatctttttaaaaaattttaactatcaataagttttttgccaactatttgatctgagctttcaatgatcaggcattagtaatttgacacttgtattatattgcaaatagggtataggttgtcctcaaataatgattgtcagtgtccataaatttatattaaaaatttaaaaaataagatgtggtcaatactttccaaaagtgatagttaacatcaatatattaccttatctaattttggccacgtacttgttagtataataaacataataaagtttattattttacaggatggtgtagatagaaagatcaagtatagatacatttaaggttacttgacctcaatatgtgtttatacattttttatggccatcatactattaatcttttttcataatactttgcatgagtctgattattaaataaggcttaaatatcatatttgaatgaactctaaatgaactacctggtggggtggtgaattcctttctagagattaaaccggtcaagctcctcagagtgcagcacagttgataaccctttgcctggagaaggagaagaagcagaggctgaacctatgaattccgatgagccagaggcctgtttcacagatggtaagacaaaaattgagaccttggttagcattccttaattagtgttctggggtttgtcttaacgcctaatacttaccagaggttgtcggtaagtcagaagactccattccatgctgattcagctatagctgtatgatgattaagggcaagtcactagagctctctaagcttgagtttccacatctatggcacttgactaacagtaatttcctatcactgtatgttagactgtaagcatgctactacttcttattttagagccttaattcgtattcccagatcaatggaaccaccagaatacaagttaatgaaagagtctgtactctggtccttttaatcaaaaatggaatctactcactaactctcagaaaactgtttgatactgttgactacagtctctctcaaaattcttcctttccttagtttcagaggccatagtctacctttggtcttttatttgtcttagagttctgagttcctctctctatttctttaatgagtattttttctgcacatcctgtaaataatgatttctccccacatgttcaatcttcagttatcttttcttattctgaagctctgaggtgtttcatgcatgcctgtggcttgaaaagccatttctgtgctattgactcttaacatcaatgtctttacctctaacctcactcttgagtcccagatctgcttacaattccccattggtcatcaccatctgttgtttgtaaaacattccaagtttaataagtttttttttttttgaaaagcaaaaacaaaaacaaaactttagtatggtttacagcttcctccagtctttattagtaacttcatgatctaccttaccctcaagctaaagactttgagagacccttaaagttttccttgctagtcacaagttcatcaggaactctggagatagggcccaagcccttaagaggatttgcatgcacactaaaatgtgagaatccttggcctctagggtaaagtctgaagtccttaacttgacatgtaaagttctttacatttggccttagtctcttgttttgtaacagtacctccttctactcctgtatgctttctgatatgctgaatttcttactacttctggaatttgtcagggataatgcagtattgtctgaacaagtattgtatcatctaggtaaaaatacaagcccagagtagggctgcaatgtaatacagtaatacaaagttcaaactttggagcctgataaacatatgttctaatttgccgacttatctgcctgtgagaacttgtgcacaatttaaaatcttgttcttcagatatctcatctgtaaaatggggatatcagcatccacatcacagcgatgctaagaggatcaaataagataatgattataaacttactagcacagtgcctatcttccttcttctacttttcttattcttcaaggattctgttaacaatcttatacagaagttatgatagcacagatgctaatgacttatctagtcatgggcttaccctcagcattagtattttttgaaaaatcatcgacttgctttcagtgtccaagattttctcaactggtttcttataacattcatgggttaagcaaaatgattggaaaataaagacatcagcaaactacaaagagtgcatggattttctttaaatacacaccaaatatcattttatgtaagaagcaaaggtgtacgacatccagtcaatataaattttgtgcttgctgaaattagtgctataagcaaatgcacagtttcctttaaaagtgtccatgttacagagatttaagaatttcatcaacatgtatggcctgctcctcaagaaatttattagcagtatatagacttaaatttgtattgatgctaccaagattttccctattcattttatgaatgatcatgacttaaaattctaggataactagaaagaagttgggcttatcaatcaacttaaagtttcaaaccaaaaaatgacttcaaaaaacttaaactcttacagaaagtattaatactatgctatttcagactgtaggtgctgttataataagatataatacaaagtttttttaatcctataaacatcaatgaaaatacttttgtgaatactctgagattattcattgcttccaaactgaggccagtatagaagaaatattatggaaacacattttccaatgaacctgggcttggaccattgaaatttactgagggagcatatatctctgagtcacatcccttttatgtgctccagcagagacttcatacagtctctggatctgtagcctaataaattcagtgaagcagccaatttgcttagcctttcaaccgtgtattcacataatcattctttattccagtaaacaaataattattaaatacctgtgtgccaggtccagttccaggcactggagggagatggagctgtgaacaaaacaataccccttgctgaagaaacatatcaagatgtagcaggtcagataagtgaaaagtgctatggagaaggtatatggaaaagaggaataccaagagtgagggggaagaacttactagcacataaatatgctatcaatgaatgattggtcagagaaagcctgcctataaaggtggcgtttcttccgtgatgtaaagaaaattgaagggggccgtgcaaatatatggagggaaagtattttaggcagagtaatgaaggcacatgccccaaggtgaggatatgcataacatttgggaaaaaccaagaggccaaaatagatggagaataatgaaagatgggaagaggattaaaagttaaggtcagaggctgggtgaagtggctcacacctataattccagtactttgggaggccgaggtgggcgatcacttgaggccaggagttcaagaccagcctggccaacgtagcgaaaccccatttttactgaaaatgaaaaaaaaattaattgatcttggtgatacatgcctataatcccagctacttgtgaggctgaggcacgagaattacttgaatccaggaggcagaggttgcagtgagccaagattgtgccactgcactccagcctggacgacagaggaagactctgtctccaacaaacaaacaaataaaacaaatgacattatttttaaaaagtgtagatcagagatgtagtagaggccagattataagacatttgaagaacattataaggatgtgattttaaaatctcacaatgtgcaatcttaagagtggaagggcgaatagcaatggcagaagctggaagatttcttggagtttctgcataaatccaggtgagaggtgatgggagcttagactagtatggtagagttttgtatagtgagggtgtgacatgctgagtatattttgaagttagagctgaagggatttgttgatggattgaacattgggtgcttaaaaactggaaatgcatagtttccacatgaagactgagaagcatgggcttgtcagaatgaagaatcatgaacatgtttacttacaagttggtaattggtctacaagagctgggctagaatcaatgccagttcagagcaatgtttcacctccagagatctctgctacctgaaaggtaacagaaaaaattaaatgaagtatgaaaaagaattaaatccaagtagcatgtttttactgaagataaatgttaaaacgattttgttgttcatagtctcacatttgttgattcatttcagcttcataattatcactttactaatgtatttcattgattgcatctggttcctcttattcaccttttctctccctcttatgcaaggttgttccttagctctgtgtctattactttgtatttgaagacttcagactgcttccgtatatcttgccctgttctttactatccttagttctacatgacttggcaacctatataattatgaacatgacatgactctttgggtctatgtggttttatattgtgctgcttttagattatcaaattagtaaattacataatcaggattagagttagcgaaaaataacctttttcacaaggtcaagagatcgagaccatcctggctaacatggtgaaatcccgtttctactaaaaatacaaaaattagctgagcctggtggtgagcgcctgtagtcccagctactcaagaggctgaggcaggagaatcgcttgaacccaggaggcagaggttgcagtgagctgagatcctgctactgcactccagcctggcaacaaagtgagactctgtctcaaaaaataataatggtaataatagtaatgtatttttctgttaacttggtaggagaagccaaatcatcttcctttcaaaatgttttgtattcacccccttcctataaaataactaataattaattctaactttagtaacacaataaccaactcctttgtgacttttattttttctttcttttggaaagataatgttaacaaatatttgttttagttatatttgatgttaagaaatggtgaaaaaagcttgttttcataatcaatttttaaattaattatattgatcatgctgttatggtttttaatgaatagtctgtcttttgaagtggtcagtggtttcttttttctttcctttccttttttttttttttttttttttgagagctttggtttaacatgatgaaactcagcatagactttatgtaatgcaccatgagagcacattagtgaaaccacccaaaagaaatagcatttactcactgggacccattaaaatgtttgagagattctctgttatgtttacattcaattaatagtccttttaaagagaaggtatgataacattgctaaccagcttagttggaaatctcttgggatatacctttgcacaaaaaccagacaggcgctccatcactcttgcctcaaaataagagaaagaaactctctgaggtgtaataaaccctgagggcaatatttatgaaacttcatttcagattgaaagtttactaacttttctaattaggatttttagtgtttttatttcctcaatcataagaataatgtttcccttcaattttaagattgacaaaagtaaatcccagagagcaaaatcttcttaaccaaagggataattttcttatccaataatttgcccctgagaaagataaattctttcttatatgtgatcattgtttttaagtttaagacaaattctaaagcactaagttaatattaaaaaattcatctcatttttttcgctctctctggtatttttattttccctgaaaaagattaacttagagttaatttttgaccctacccttttactctgtttttatatcattttatcgaatgttctctcttaactaaatgcatgtagataataattatttaagtataggatgatacataatttcagatctgagatcatgttcactgtaattaacattgtataaatgaagctatgtgtagattttccattcacctttttttttctttttcatccaatgtttatgtaaagtatagaattcacagagatgtaacctttcaaattatgactaactgcttagaagattatataactctttttggggaatcaagtcttttaaaaatcaactataaatgacctattaagccaagtagaggactatgatgagtactataagcacaaagagcaagcattacagactcagtttgagtcttctgggaacttagaaacttccagagagaaaaaacaggaacacataaaatatacatgataacaaaaacaccagagacatagggggagagggaaacaccttgtttgctgtatttctatagagctggaaattaaagtgctagaaaataaccttatatcaactggatcaatgcactaattagacttcagaaacatgaaaagattcattacaaaacattttctaccaggtgcatcttgtcaagaggattctagttttgttgttttagaacatacaacttatgattatctgaagttgttacttgaaaactcaatacttgttaatgaattatattgttttacagaaaaggagatcaatcttttagaaatatctaaaattcaaacttctgaaacaggtatcaaaaaagtgctgcccattcttactttcccacctcctgccttcatctaaaatgaggtttttcatctaaaattttatgaggaagaattcactgtagttactttttaaagagtctctcttttcttcagagtaattctagttgctttaataaactttaaattgattaaaatttttcaatgtttcaatcattctctttctgggcctcttatgttcatagctctgtttatcacttcttataaaactttttactctttggtttctcttttactgcaccctcttggtccttcttgttcatctctcatttcatctacttcaaagttttctcctctacctgtcctagtgatgtgtaggtaaatatttttataaactggttctccaaggaaaataaaaaatgtgtacttatatcatttactataaattttactgatattaggatatatgacacacaatttacaaataataaaatattacaactttttattgaacattctgtatatcaaattgtttctcaaagaatgctttttttgaactttgccaaacttttgcatgtataggcaacctatttttgcagctaataaacaagtatagttttagcatgaagactgcttgatatttatgttagtcagtgaaataaaaaagaaatgaagaagctatatgtcagaactttactcattcatcagtgatgtaagcaattatttgcaaatcaaaaaacagaatttcaataatgaaaggatattttttaatttttgtgctattcagagtaatggctacaaacacaatacaccttgactgtttatctgttttattggcatttcctccatcaccttcttaattctactctagaaaatcaagaagctctcatttgtagtgcttggagatttttgtaatgtaaagattcccaccatcactgatttcaaactactgatgtgaaattgctaaatgcagagttaagaagagattcacagtagctcaacagtgtgacatacttccaccatccagatagaataggccagatagaatagaccagcatccagaaagaagagttgcacagtagcccaatagtatagcatattactactgtccagagagaataatccagagagaatagaccaccgtccagaaagaagagatgcacaatagcccgacagtatgccatacttctgctattcaaacggaatagacaaataaaatacagtaaaataattaggaagtgatatgtcttagtatttattacctttccttaaggtaagttatagaattctaagtttatatagtcaaatatttaataatggctgcttttaacaacagacaagcaggaatttctgacagtttaacaacaagaattggtatggtctgctttcagcacaccattgaattctctcccttaatattgttgtttcagaatgtttcggagttggccctttttctgctcaccctaaatactctttttgtgtgacctcaaaaactgttctgacttcagcagatacatgtatgctaattattactaagaattcttttctagacaggtttttcccgtttcaggttcccacccccatttttaaaatctataggatatctgtatttaaacaattcacaggcatctcaaaatcattacctgccgagtcagctcctcctcctgtggttttcaattcactgctaacatccacctggtagtcctgggatccttcctttctcttacatttgatatccaatcaatcaccaaatcctgctgattttatctgccaaatatgtcttgaatctgttacaactctagttcctaactaatctttccctccagacaggatactggaccagaatccaaatggttttctgggtatgaaactttcttcacccctactcctctctattcacccttccaacttatcctccatgtaccgtggagacatctatttacattgcaatttgcgtatctcgttccctgcttataaccctttacttactcctcaacctcaataggatataagccaaactccttaaggtaaaggccaatgctttccataatctgaccaatttttctaagctcacctctcacccttgcctcttgtgtacattctgcttgcatcacaattctaaactggtttaaatttctatgcataacaatttttgctgcctggaattccacccaaactcttttttactgatattttgattcaacccaggctccatctcttctaggaagcctctactgatctctctttctcaagaaataagccaggtgagattgatttcttccatgctatcaaaatgaaccctgactatctgtcactttagttgccatatctagttatagtcatttatttctgtttttatctacctaaccaaaacctaacataaattcactgaggaaaggaaatcatgtacagaggtgaatacataaaagatacgtaacaagggtttgatggacaaaagaatgcgttaatgaatgaataaacctaaccatttttaagtacaattttcaattttttgtagcagtatattttgtacataaaaatttaaagtcacatttgtttttaacttagaatacttgaaacagtttcatctggatcttctaatcaagatgagtttcttttgaacttaatttcaggagtttccactaattttctcaatattgtttagaaaggtgtatttcagagggtttttaccatagaggagtggaagtatctaaaattatagactagaaaaatttatctgtcagaaaagaagaccctaaaattcatgtcgtcttcagattttagttcattcattcattcacacataaaatgaaagtggtttaaagactgtggaggagactgaagagaaattggggattacagaagacaagaatacattgtaagctaaaactaactaacaactatttagaaaacatcatgcaaagttagaagatgaaggaaggcagcatccaaattaaatctatctgaaattgcaagtataggtgttgaaattatttggttgagggagtatcacagaaagcagtttgcattaaataatgtattaaaaattttatttattctgaatatcaagatttaacatgcatgtctttcttgtcaggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggtaaatgatctgacacctaagtcaatatattgattaagtcaatattctttaaaatgagctaaaagataaaaatatcatggcaagttgttttacctagaattaatccctatgattagtgccaatgacaaaattttacttgagctcagtaaatagttactgagcactcctacatgccaggcattatccttgctgccctgaatgctgttgtccaaaggaccacccagatggctataatagaaaagagaattttactggcaatatcagtttgcaaaacagggagagagtctgtggcataaactgaaagcactttccctgtagaacaaagagagaaggttagaggttttattaaaatgggaaaatgttatatattgctctttgagaaagttcattggccctagtaaggatctggggaactggtaagctccaactggcgagcaacagtcgttggcacaattagtcctagagtgtaacaggtttcctcagaagctatagataaaactaatttcaagttacaacaagcagcttcaacagtcagtcttgcagagaattataattcttggagtaatgttttgtaccctgagagcttttccccctgccttcttgactcttagttgactgttagttgagtaggacaagaactacccaatttgtatgatcaactttcacaatgcaaagataaataagatccaggtactgtttattcttaaggagctcagagcaatggagaagagaagaatacaaatgagtaactgtagagcttggatgtgtttgtaagcaaagtgtaaatgtgacaaagttctgtagcaaggagaacaactgcttgcaatttcagaaacgtaaatggtgcttttcagggtctagaaagacgaacaggaattttctagttaggcaaggcaggctgaggggaacaagtatacaatcgtaaggaggcataaaacagcatcagatattcaggaaattaaaaactgctgaactgcaagtgtggtgggaagaagaacaagtacaggtggccagagatactatgagaaagcaaggtcagcttgtgaagcatcttgtgtgttataaaaagggaaaacagatggtagttttaggataaaagtaggacaagtttctcattcttgtacacatacaagcagcttccatgagagttgaaagagatctagtagaattacaagctacctgaacctttttcttaattgtcatttttcctgctgacgctgacagagatgagccattagaagccattaggagcccagatctagctagatataccactggaagtttcattatactaaaaatagaatactcaagaactttgtaacttgcctcatagacagtcttcatgagtttggactttgattttactgtacttatatgctaataggttgatctgatactgtttcatggatgctggcagaagatatgaggtgcttgggtcagagataaaggactttgttacttatgtgtggaaagtagcatgagtttcaacatgtttctgttggttccccctttacccaggtctcatgggggcattatatgagcctgaatgagtgtgtacacatatagtggattgatgtcacagctgaggaacactgagcttagggaatgcatccttttataccaagcaacataagcaaccctgctctttgtcccagagaccctacctcatgtctcaaggttgctcactgcaaacacaaccctgaggaatgtcctaggtaaggagcaggcagagcctggcattcttggcacactccccaacaacctgcagggacccactgtggctttcctttcctatcaagtctcaactctcagaaacagaaaatgtgatcagaaaagctctattttccttacctggagtcatccaagtagaaatcatgatagtgtctaccatgcaatgtattcctagtaactaaggaggtttatcccatgctgactcacatatgtgactgagaatttcagagaggagattacaaaaaaattaaagtttggagtaattccttgttcaaaatgtctaaaacagaggaagacatttggggagggcattctcaaaagtgtattttaaataaatcatatgaggaagaaaagggaaagatatttcaagaagctggtgtttgtacttagacaggttgccaattaaactagattttttaaaagtatagcaaacccccatgacacgtgtttacctatgtaacaaaccttcacatgtaccctcaaacctaaaataaaagttaaaaagaagtaatagctctcatttagcttatacttattgtgtttcagaatcttcttttagattttctcatttaattttcaaacaaccctgtgagattatgatattttgcttattttaccaatgatgaagctgggtacagttttaaaagttgcttaatgtcccaaagctagtaaatgacagagctatcactgaattgacatctaaaatcaaagtcaccatatcttttcactgtgttgtggctcctcagaaagaagagtatacacaaaacagaaataaatgagtggtaactgaatttagtaacagtaaagcgttaagtcctaaatcagatagagctcacataaggtcattcttgcctccttgctcctacatccacaaaattggttctggaagctagaacccctgtgggctgaattctaattcctgctctgggaccagtcagagagaggttctcatcatcaagacttcctgcggctctgctctgaccctgtacaccagttctagaaacaggcttcgttttccttgtgactaagccccttccttgtctttgtatttcaaggactgagtcattgccatagtttcggtttagatggcttgcctgattcctccagaatttgggggtggagtggaggggaggaaaatcctgagggctagaagcctccctctgcacttcaattccattgaatttcagaacctctgccaactgctgggaccttctttttgcatcttagtaggtccattcagtctttctgccccaacttgtctcttttcttcaatattgataccaacagtttcccaaaactgctaaggataattttagagtattgaaagcagaacgtagaataagaagaatctgaatggcacaagttcatgactgtagacaggtaataaatataatattaaccacgaaggatacaggtctttgactttcattttatccaacagggttaatagtgtttcgatctgaaagagaaagttctaacactttagacctgttgagatcagcaatcattttcagtgtctcaatgagccttttttttttttttttttttgagacagagtcttgctctgttgcccaggctggagtgcagtggcgtgatcttggctcactgcaacaatgagcccaatttttcagtcctttcaaattctttgtcaagggacatgtggctgaagtctaaagtcaaagtcaccctgtcctttcactgtgttgtggctcctcagacagaagagcatacacaaaataggagtaaatgagtgataaccaaaattagtaacagtaaagcgtaagccctacattagatagagctcacctaatgttgtcacataatgttgtgtgtcacttactaaaatttcttggaaagcataggaagcaccgcattaatggagagaatagaacagtgatttttagagctgaagctttgaaggataatatatggatgaatagtcaaaggaaaaagcaccctctgtgttctataggcctattaagctactgcagtcattcatttagcaaatctttcctttcctgctgctgttattaacatggtactaggcactgggatgcacaagcatttgagagctgaaagacaggctccacatcctactggtggggaaaaaggggagtgtaggatgtgaaaagtttataacagtggctggccatgggatcatgtcttaaattgctaggacttatccaattttaatggagaaagaggaggaatcagatggaggtggaaatgatcaggtgtcagagatcatgagtctttttgtggattataagtaatttcattcttttgcactttctcttgacctctgaagaccagcagcagcactggtgagaaggctagaactaactgttatatgataactgtaaaccagaaaaaatgtcagctggcccatgtcaatattatgtttcagcagtcttagcattagaattgtatttttcctgttttttttaaatgaatcatgaagcttaagttgtgcatgattgaaacttgaatattatttccacaggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtaggtacttttgagtacattttaaaagaggatttattcttactgtgtgttgtgaaaaaaccttcaccactattgcatattatcatattttaattttgttaagcttcatatattttcaggctataggtttattcttttagaaatattaacacagccagtggaaatatatctgtgaggaatattagaacagaaatcgttcaacaaatgtaaattatttctgtgacattgtaacatttataattgagttttttatgttttctgcaaaggagatgtgattttttaaaaaatatgatttgaatgtcattcttgttaagaataaaacaaaatttagaagtaggagatgataaaagggcagagacacagattaaagagaggaaatgatgattattcataatgtaaaattggaagataagagaggatgaggggcacatcaagttggctgatatgtgagctaaaatttttctaaaaatcattatacaaatacaaagttaactttgtatttggggagagagaagtcatgaaattttaaaatatctatctcagacccaattataggaaaaaccaaaatgagacacaattgtctctatctcaaatatgcgacttgcccttcatctccagaatggcagtggggcagaggagtaggcattattattaatgtaataattttagataataaattcaaagaactgttgaatacttggatgatggaaaatacataataattctttagtttacatattattttaacgaagtagaaatatttttacaggcttctgattgagatagagaagaaatcttaaaatagtcggtgagatcaaggactctcaaatagaaactaacggtacaatacccattattatcatttcattgaatgtactctaattattttatattttaataatataacttaataatatatatgacatattttgtattaattaaaatggctttcttacattattttataacctcaatctcccagtcttatttttctcagaatgatatgttctttatcttttactaattcttctagattttcagaaacctaacctttgtgtttagggaagaaacatcctataatcagtcatagtttttagagatttgttttccatatgatgcctgacataattagaggtcaacacgcaaatttgtatatgccaataagtgctttaaaatttaaccaagggtttgcattatcgagcttttaagaaaagttgaattcatacagcatcatatgtggattagaaaatcacaagtaagcatgatcatacatagtaaaatctgactgcaaaatgttaccaaattagtcatatttactcaaaagttcaatttctcaactgttattcaaagcttcataaacttttggcttctggccaggcgcggtagctcacgcctgtaatcccagcactttgagagtccgaggcaggtggatcacctgaggtcaggagtttgagaccagcctggccaacatggtgaaaccccgtctctactaaaaaatacaaaaaattagccagacatggtggcaggtgcctgtaatcccagctactcaggaggctgaggcagaagaatcgcttgaacccggtaggcagaggtttcagtgagtcgagatcgtgccactgcactccagcttgggcgacagggtgagactccatctcaaaaaaaataataataattttcgttttcttaatcacacaacatattaaatgttaaaaacaataacttttttctataatatgtaatgtgaaaaaatttttaacatagctatatattacaccttatatgtgttatcttaggtttcctctatgagaattctaacttcggatatagtaatgatttcttgctatttttcaattaatcattcatatatcaagttatctagttactgcctaaaaaatgaaaaatgataaaatgggtatttttgtaatatagtagttttgaagaaaggctgccccaaataagaagaaattatagaaggaatgtagattttcttttctcttaaactgtaaatatgacggggtctctctcttaaaaaattatacaatattttagatattttaaaatctttaaaatattatcacaaatacactcattttcatcattcagtgtaagaaatgaaggtttacaagtaaaattgaacttattttaaattaagagatatggctgtttaataatggaaattgttttatttgaaaatttaaagtgatgattctcagtgagtataacctcctgttcaggggtatgtaatgtgcagaaatcagggagataaacaactccaatttgaaatattatttaatattttggaaacgaacaaatataatgcaaagcacagagagtaaagctccacacaatattcttgctgacagagatgcaaattttgggacacagatttgggggagtggctgattttttttttttctgaaaagtatagaaacttatctacagcagttgttcttgaaggatggtctcaaaactgaaaacgttggcacatgtaggtgagaactcataagagatgcaaattctgcccccaaccccaagacatactgaatcagaaactctggggttggatgtggcaaatcattgtaacaagccctacagatgattctgttgtatattcagatttcagaactacttatattatttgctactcagagaatggacttgtctgatttctgcaggcttctgggttatttgaaacttacttgattaaacagtgttcttcagtacaggcgtatatttgtatatatacgtgtgtgtttatagaaagatgtgaatatatatgcatatatattctcagttacaaactataccatagtcttaataatatgcatatattccgtgtcataaaactcacttaacagtggcttggagaacagacctattagtattttaggggctgtatcaattataacagacatgtcttagtctaccttttattgctgtaactgaatacctgagactggttaaagtattcaataaagaaatttatttcttaaagttctggaagctgggaagtctaaggtgaagggtccacatctggtgggaactttcttgctggtgggcacaccagagagtcccaaggcagctcatggcatcacatggcgaggggtgttcactgagagccaaactgggttttataataaacccactcttgtgatatctaactcactcccatgataacccattaagcccttactctatattccattcatgaaggcagaaccttcatgacctcatcaccttttaaaggctctgcctcttaatactgttacattgggaattaagttccaacatgagtttcaaaagggacaaacattcaaaccacagcaaaacattaaaaaaaaaattttctgattaaagagggagcatacatattttcaagtgttcttaagtggaaaataatggatgtgaatgactgggcaaatttaagagtggcatgaggagtaatttattctgctaaatacgtagctttaggaatttaaaaaaaaaagccatgttacatttagtgagacatctggaaatactacatgaggatgagcactttaaaacacttcccgcttcatcagtcagtttacctgtctctgatggtaacagcaatgaactttttgtgaacaatgactttttctacgcctgaaatagataaatatataaagttggctctcatctgttcctattcttccctcgaaaaattgaatctctcagtcactaacttattcgtaatgaagaactgcattccagacatttttcttagacatcgtctcctgctacacaggatgtgaggcaaatgaatattttccatggaactaattcagagagtaaacatatttatagatccagatctaaggtcatggaggagctcattgctttgtaactaaaatgtgtattgattgtattgctgttcatgttctttcttaagataatttacgataagaactcaaatttcttttggatactggttatggtaattgtggctgatctatctaacatgatgaagctcttattatatctatattgattgtgaagccaatgagatcagctactctcattctctcttcagtacaattgtgatttttctcccatgaaaaactatttggtagatctttggtgctaatctttagaaattgtagggcagaagcaatcttgttgagaatttgccccaactcaaaatcatgagtcttcaaaatgttttttaataagatttatactaagacatagatttagttgagtgaataccacacttttagggcttagcttcagaatcacacacttcattttgacctgagttttataattaaaatgttcaccattgttctaattaaatttttagatttaataaggaattacaaagcaattgattacaaaagtgtgaaaagcatatgcatgatttctattcaaatagaataaacaacttactttgcttacattatttcttcttattttggttaaccttcttttaaatctatttccttacagaaacatccatcttaccctatttttaggcattgactacacaactccgtatataccatcttattgttcctgttgagttgcttttagtgagtttcagaattgactttttccttttatgcttcatcattttattgacacaattaatgaaaatgttatttttataggtttctttggttactttagtggcaaacactcttggctactcagatcttggccccattaaatcccttcggacactgagagctttaagacctctaagagccttatctagatttgaaggaatgagggtaagaaaatactaaactttataatgttcttattttttaatggggtttaaaatataaaaacaatgggtatgtagaaattatgagttgtttctgtttacataaatacataggctgtttatgtatgtgtgtgtacatatacatatatacatatgcatatatgtatatatgcatatgtatactatatagtatgcatttacatactatatacagtatgcatatatactatatatagtatgcatatatggtatatatatgcatattatatacactaatagtatatatatgcatattacatatactaatagtatatatgcatattatatatactaatggtatatatgcatactaatatataaatactaattatagcattaattaaatagtatattactaaaaatagtataatactcattagtatatactagtatattactaaaaaagtataatactaattagtatatactattatatattaatatatacagaatatgaaagactatatataaaatatgcatatatagtatagtatatatattatttcatttactgtacatattagtatatatatgcatactctctctctctctatatatatatatatatacacacacagtatttcagtgcatattgtttaacaagggaataagttaatcacagtaatcctgcctttatctaatattgtcaaacaatagaatgatccaaatgagtgacttttttcatattaaatggaaatcttccctgtgctaggaagtccaagtgaaaggggaaactattgttcctaacatcatctctcatacataagtaatcaaggacctacttatatcaggtgttcaaataatatttgtttaagaaactacctgggtaaggagcattagaaaagataggtaagtgagacagcatcagccatcacatttaatttcacctttaaaataacattgcaaagtaagtggaattataactaaattatatttgagaaaactaaagctcagagagtttacttaatttgcacttaggctgcagagtgcctgaaaagatactcaattagcagagacaaacaagttataatgaataacaactaccataacctagctttaaggattgtattaaaccagcaactttgtaacacacatggaggacaacaactctattttctgtaattagtccatatcctcatgtgttggtactcctctaaaatttcttctccagatttatacctgctattttatgcctctgttctggaatgcttcccctgccctgtcccgaccctaacccgtttgtatagcagacaaacacctatctgtcctttaaggctcaatttaaagttgccttgtccgtccaccaggagacataactggatattctctctctgttcagacacctaaaatcctcattatattgtattttacttatttgtttacttaactgcctccctaccttaccttctctgagcaatttaacacggagattagtccagcttactgatactttaagtgtggtttactgaccagctattagcattatctacaaacttattaaaaagacggacggatcatgaggtcaggagttcgagaccagcctggccaatatggtgaaaccccatctctactaaaaatgcaaaaaattacccgggcatagtggtgctcacctgtagtctcagctactagggaggctgaggcagaagaatcgcttgaacccgggaggcagaggttgcagtgagccgagatcatgcaactgcactccagcctggggaacagagcaagactctgtatcaaaaaaaaaaaaaaaaaaaaagcaaattcttggatctcaccccagacctactgagtcagaaactccaggatggggataagaaacttgggttttaaccagcctcaagtgaacattagagatctttcagcctaccaaatcttcactgttatccctacaaacctaattatgactgcaatctctgctattttaattatccagtgtataacggtttccaagtataaaagaaagatcatgattatacaaaaaagttcataagcacaattcaaaaatattctatctacaagttgaaaattacaagtttcattttgtgcagaaaggtggtattagaattcattgacattaacttaattttttgagcattaatagaatgttacaatctatcacaactttcccctacaaaaccacttccttcagtgattaagccagcccactatttaactctgtttgctctttgttctttatctgtattacaggtgaattggatgcaggagaatagtttagtatattttgagaggcaaatgtctatttagttacatttgttaaccatgcaaaaagagacatttattcatgccgcagggctattttgaaggataaatgaaataatgaaataatgcatttgaggcatattgtagtcagcttgtttgagtccttaggctctttagctttcccaactggcttctcatcagaccaataggtgcctgtctttctcagagacccatgattccatcattactcacattttttagaaaaacattttaaacaccaactatgtgtcaggtgttgtgatataaaaaacacagagtacagtggtacatagaccccggtccccaaagagtgagtagggtcaatggttacaagagagacagacaagggcacataatgatacaggaatatacagtagggagtggctatccggggaagtctgggaagacatcacaaggaggtgacatttcagacatttcatgactgaagagtaagccccaaatcataggcagataggcattcaaggcagtgataccacatggtagggaggcacagaatagattgtgcaaggtgtgcttggtcagtgactagatgtatcagagtgcctacgtgataaacatagtagggagggcagcaggaaatgagcatgaaaaggtaggctctattaagagctggctactttgaacttcattctctattcctattcctcctaatcttttttgaggtcacatagactgtaagaatctgatgaaagttagaattgtctttccggaaagacagcacaaccataatgtttgttatataatttcatgcccccaggaaacctctacaggtccatgaactccaaataatcattgctctggaccaaaggtcaacaaaccccagcctgtttttgtaaaaatgttcttggaacacagccataccagtttgtttatgtatgacccatgactaccatggcagagttgaatagttgcaacggagatataacccacaaagcctaaaaatatttataaaaatgtttgcaaaccttctccctagatgatctgattagtagtcagagatccttagtatttctctattttaaagcatcttgagaacctgcttaatacattgcagaaaagaaggatcccagtgctccttccctaacaggttaatctttaacacatttgtacttgaatgggtgctcaagctgaagtgtaagatgacaggtaggttttgaaagattaagtaaataagaaaatctggagagtgttaaatgccacaggaattgccctggatgaaaactggagtggcaaagacaaactggtgatcaatagcagtacaaatgctgaaaagcagaaataaagaaaggattaaagaaaaactgttcctaatttttgtcttaactgaggccagcactatatatatttagtcaaaggcttacatataaagtatttagagtaataataataaatttaaaacgattgctcttatttcgtagaaccagccaaatctaaaggatttaaaccatttaaagattctcaatccttttgtggagaatgtctcaaaaaaagagaataagaaaagaaaataattaaattaaattaaaatgatgtccagtcataattccacctacctgatatacaccaatagtttctctatgggggaatctttaatgctggtaataataggatcatgaacatttaaatgtatataaatatatatttttcatttatgtttatacatttcttttttttccagagtgtacagattttacaagtttaccttatcaataacaggttttggtttattatttttatttattttacatttatttaagctattatattatcttagttattttgtcttatattttgctaacaattttattgtgtgataatcatgtaatttgtaagcctggtgatcacagagttcatgtcttattttgtcttgcttggcacactgctgagtgtagagtaggcatttaataaacatgagtcggctggttggtttgatgtcttagatatttaagggcggcttttctaatttatttatgtctgcatggcatttctttcatgttgcctatttaacatcttactaatcctaatcatgcttttctttcttttgaatactaggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgtaagtgtcccatttcatgagtgcttggtattttaatagatattggacgaaggatataagttattctttaaatagtatattaattataaattgaagataaaatactgtgtggtttttaaaacagtgccagtcttggccgggcgcagtggctcatgcctgtagtctcttcactttgggaggccaaggtgggcagatcatgaggtcaggagttcgagaccagtctggccaacatagtgaaaccccatctctactaaaaatacaaaaaaattagctgggtgtggtggcaggcgcctgtaatcctagctgcttgggaggctgaggcaggagaatcacgtgaacctgggaggcggaggttgcagtgggccaagatcgtgccactgcactccagcctgggctacagagcgagactcttgtctcaaaaaaaaaaaaaaaaaaaaaaaaaagtgttggtctttcctagaacatgttcctacatgaataagaagcatgggttctgttgcatttgagttattaatttataattgactctttggtgtcatgtggactcccatcttgcaccattcaaatattgcttcaaaaatgaacgtttttgaacttcctgcttcacactatgaagggatgagaggaacttcccacaggcatggagaaccctttaaaaaatggagaaaagatgtttcctgtcttattcataaaattttccttcacctttaaaaaataaaaggttatgtgcgaaattcacaggcaactgtaacaatttagaaataattaactgggactaagatttagaatgttacttgggaatatgtcctttttaaaaaaatctttacattaaatggacatgttgaatacagcaaaacttactagtattacttaataattgtggtaacattaaacagacaaaactctgtttatggctattttagaatatgagcttaacattcaaattctattaatgttattcttaaaggcaacttttaagggatggacgattattatgtatgcagcagtggattctgttaatgtaagtattgattatcttagcactaaactttatttttaaaagcttcttagtttatttcagtgatttccaaactataacttcatgaagcccttgggactcacatagacaatgaagaacatccacctgatagtagcctagtggttgtgagtacagcagttggagatagagcctgattcaaattctagctgtaccatatcatccaagctctacaactgacttcgggcaaattaccttaccttcttgagacttagtttatttgtctaatctataatttaatgaatctatcatttgtctaataaatgtctacaatcatccaatgcctactccatagtgttgtgaggacccaacaagaaaatagaagcagggcacttagtgcaggctggcattactaaatgctcagtaaatatgcgcttatcaaaataaaaataaaataattttaatgtatagcttttactgtttttacagtttaaaacaccttggatgagtttatgtgaaataagttccatgctaagaaactttaatgattactccctaggtaatatttttacaaaatataataaagatgtattcggaatcaaaagaaaatacatggcaaaatgtgtataaatatgataatgtctcatttacagtacttttggaaataacatatacatagtatgtcacttagttattgaattttcctaccaatatgagcacaaatatgcatatgattaagccctttgtagttatttgaagattatattatttattacataagtatgtaataaattaaataataagtatgtaatgaatacatgttgaataaattgttaagagtgattatgttaaacctcaacaatgctatggcttcttaaatcctatgtttacctaggatagcactgtttgaattacctggtcaaaccatgtgaaaaagaaaataatgaatgttactgtccatataatgctaacttttgtaaattttataggtagacaagcagcccaaatatgaatatagcctctacatgtatatttattttgtcgtctttatcatctttgggtcattcttcactttgaacttgttcattggtgtcatcatagataatttcaaccaacagaaaaagaagataagtatttcaaatatttttcattgtaatgaaagggatgaacaattattttccaaaaaagataatgtaaagtttaatttgatatcaattcatgattaattttattagaacttcatttatttttcaaataattgactagtatacaattacaaatatgcttaatcttattcatttttgcacagaaaacaattttctaaataataggttctggctaacttatgatttaggttaaacccataggttttgagcaatatatcaactattctgttttttccaatgtttcctatagaggattgaataattaagaaaaatcaatacactatttattcaaaacacattttataagtagttatttattttattttgtgtaatatatattgggttggagcttggggagaccaacgtaagatatggttcctgagctcaaggagtttatgtcatagcagaataaataacacaggtaatgaaaattaagacttgttgaatactgtaatttgagcaatcttctgaaatttttaattaattaatcttcacatcaactgtattagtttctttgacctacgagaacaggataatacaaacctgagggcttaaaacaagagaaatatattctctcacacttttggaggttagaagtccaaattcaaagtgtcagcaggtccatgttctctttaaagcctctaagaaaatatattttattgcctcttccagcttctggtagcccaggtgtttcttggtttatggcaacagaactccaatctctcccattatagtgacatgccattttccctctgtgtgtctttctcctctactagtaaggatgccagtcacactggattaagagcccactccactccagtatgacttcatcttaattacatctgcaatgacattattttcaaataaggtcacattctgaagtgctaagggttaggacttatatgtaccttcttagggcacacaatccaacccataacatcaatcacaaaagtattattacagagtctctttcacaaatgaggaaaggcacacagaggttaagtgacttacccaaggtcatatatcgagtatgtgatgaaggttagatagagtcagtagtaaattcgatgtatcttgtactctattaaactctctactatgctctatccccaaatactataatcatgataaatacaataagaaaaattaacaagcacaaaaaatatacatgacagtcagagtaaaaatagatgctgctatagaatggtttatgaaatacgtgacaattgagaaggctttggaaggtgggaaagaagacatgtagcaacggagaggcaaaagaatggctaacccacatggagtgaaacagaaatgaatgagcaaatgaattgtgttgataaaagaggcagcaattcaggggggatagcaatgctttcggttttgaagaaatttaagatttggagaaatagtaaaagatgaggttttaacctgcctgagagtagatataaaaagccgtattagaccttttttaatagcagctggtgtttcattcatatatgttgagtagggaagaatatggaagcaggagattgatgtttattaagactccatgatatgtcagatcctgtgtaaaatacttctaacataattgtagtcaaattttacaacaaatctaaaagacatagtatcctcatttaacctctcagaaaaattatcttatttgcacatggcctgacagctaaaaagtagtttcattatggatctagctccagaattgctttttctagagactgagctttacaaaaaattaatctagcagtgatgcacaaaatgactagggaaggaccaaagactatttcagaccctgcttgacctgccacctggaccacactaagtctccaaattagtcctgtgtgtcaatggagaataggaaatatgttccattaaaacattttagagggtagaatctacagtattgcttgtgatttgcaagagataaaggagtctaattctggagtttcttgtcaactaactgagatactctggttgtggtaccacctatacaaaaagagatctttggagactaaatggtagaattacaaaagagaataataattttgggtactggcttagcatctaagaagacagatgtacatgtaccaaaatgtcattagtgtgcatgattgactatttgcaagtagacaaaaatttagtaaatattgcattatttatcctgacatttacaaatacagatgtttatttttaaagatttttaaatttcatgttccattttacatttataaagtgtacactgattttcaatttatttttctcaacttaagcattatatatacatacatgtaatatataagcacacacaagtaattcctcagtcttccctgcataggataaattaagcgtgtctagaaagagcagtatgagcataaataaaacagccaacatccaattgactttaatcttcctgcttgttaatgttattcttacaacatttctactgcaggaagtaaaataggatgggttgatactatcaccaccaaagtcaggaaacagttactgatttagaagcatcaaaaactcatatcccctatcattcttccagtatttcatcttgcaatctaagtatagcttttattttctgaccttttctgaatgatttagaatttctttccactcttccctgaaaaaacatgaccaacacttcaattagttaacacatgctatgtagaagtacgtagtagatgctttgtgatgaactcatttattccaaagaaaaaaaacaaatgaaagtggtatccttttctttgcctttcctaattttaattattgtggtaaggaaacttaatatgagatctacctgcttaacaaaatttttaagtatactatatatattgttaactatagttacgaagtactacaggaagtccctagaacttattcatcttgcataattgaaactttattcccattgaatagcaattctccattctcccatcctttcatgccctggcaatcaccattcttctctctgtttccatgagtttgaccattttagttacttcaccgaagtggaattatgcaatattttttctgttacttcactcagcataaatttatccaggttcattcaagttgctgcatatggcaggatttccttctttataaggctgaatagtgtgtgtttgtgtgtgtgtgtgtacgtgcacacgcacatgcaggtatacaaataccacattttctatcccatcattcatcaatagacatttaggttgttttcatatttggatacagtaaatagtgctgaagtgaacatggaagtaaggactctgagatcctgagttcaaatttttaaaatatgctcagatgtggcattgctagatcaaatggtagttatatttttaattttttcaggaactttcatactgttttctatggcagctacatcattttacattccaacaatgtacaaaggttctaatttctccatatccttgccaacacctattatcttttgatttgggtggtttttgtttttgttttggtaatagccatcctagcaggtatgaaatgatatctctttacggttttttgttgctgtttttttttttttttttttttttttttgttgtttttttttttgagacggagtttcgctctgtcgcccaggctggagtgcagtggcgcgatctcgactcactgcaagctccgcctcccgggttcacgccattctcctgcctcagcctcccgtgtagctgggactacaggcgtgcgccaccatgcccggctaatttttgtatttttagtagagacggggtttcaccctgttagccaggatggtctcgatctcctgacctcgtgatccgcccgtctcggcctcccaaagtgctgggattacaggcgtgagccaccacgcccggccttgttgctgtttgtttgtttgtttttgaaggagtctcactctgtcaccaggctggagtgcagtggcgcgatctcagctcactgcaacctccgactccctggttcaagtgattctcctgcctcagcttcccaagtagctgggattacaggcatgtgccaccatgcccagctaatttttgtattttcagtagagatggagtttcaccattttggccaggatggtcttgatctcctgacctcatgatccacccaccttggcctcccaaagtgctgggataacaggcatgagccactgcacctggccctcattacagtttttatttgaattttctgatgattagtgatactgagcatcttttaatatacatgttggtcatttgcatgccttcttaagttgcaggagttccctatatattttggatattaaccatttattagatatatagttggaaatattttctcccattctataggttgctttttcaccctcttgaatgcttcctttttttcccaaagctttttagtttgatatggtctcaattgtctatttttgctcttgtttgaattttggagtcattgccaagaaatcattgtcaagaacagtatcatgaagctttcctgctatgttttcttctacaagttttacagttttcaggtcttaggtttaaatgtttaatctattttgagtttatttttgtgtatggtataatataagaattcaattttatttttttatatgtgaatatccagttttcccaacattatttgttgagtggcctcttttctattgtgtattcttggcacccctgttgaatatgagttaactatttatgcatgggtttatttctgggctctctatcctgtttcattggcctatatatttgttttatgccaggaccatactattttaattgttgtagctttgttatacattttgaaatgaggacctgtggggactgggtgcaatggctcatgcttataatcccagcaactcgggaggctaaggctggaggatcacttgtggccaagagtttgagaccagcctgggcaagatagactccttctttacgaagatatttgaaaagtagccaagcatgatggcacacacctatagtcctagctacttaggagcctgaggtgggaggatcactgaagcccaagagtatgaggctgcagtgagctatgatcatgccactgcactctggcctgggcaacagggtgagatcttctctctcaataaataaataaataagaaatgagaaaatgtgattcttccattttgttcttttttcttaagattgctttggctattcagagtcttttgtggttccatatgaattttaggatctttttttattttagtaaataatgctattgggattttgatatgtactgtattgaattcacagatcacttagggtagtatgggcattttaacaatattaagtcatttaattcgtgaatactgggtctttccatttatttgtgtcttctttaatttccttcatgaacattttgtagttttcagtgcatacattttcaatgccttggttaagcatatcctaagtattttatttcttttgatgttatcataaatgggatttctttcctaattttctcttcagattgtttattgttagtgtatagaaacgcaggtgatttttgtatgttgattttatatccttcaacatctagtaaatttgtttattagttctaacagattttcctgatgtgtggagtctttagggtactctccatataaaataatgtcatctgtaaacacttttttctttcagattgggatgtcttttacttgtttttcttgcctaatttctctggctaggacttctagtgctgtgttaaatacaagtggcaagagtagccatatttgtcttattcctgatcttacaggaaagtttttcagtttttcaccattgaatacgatgttagctgtgggattttcaagtagtctttgttatcatgaagtatatttcctctgttctcatccatttgtgctactataacagaataccacagactgggtaatttataatgaacataaaccttatgggatcacagtactggaggatggaaagttcatgactgaggggctgtctggtgaggtcttatttgttgtgtcataacatgctgtaaggtatcatgttatgatacacatggcacaaagagagaataagtgagaaaaggaggcagaacctgcctgtttataatgaactcaatcctgagataacagcattaatgcatttaaaagggtaaaattctcataacttaaacacctcttaaaggtctcacctcccaattctgtcacaattgcaattaaattgcaacatgagctttggaggggacaaaccttcaagttatagcaacttctatacctagcttttgttttctttttttagtttttaccatgaaaggttgttgaaatttgtcaaatgcttcttctgaatctcttctgatgatcatgtgatttttatccttctcagatcatgtggtgtatcacattattggtctgcatatgttgaaccatccttgcatcctagggacaactcccacttggtcgtagtacatgatcatttaatgggctgttgcattcagtttgctaatattttgatgaagttatttgcatctatgttcatcagggatcttgttctgtagtatgtttttttctgtttaaatatttgttcatttttaattgacaaaaattgtgcttatttatggggtacaaaacaatgttttgatctacataaacattgtagaaattttcagtcacgctaattaacataaccatcacttcacccacttatcatttttttgtggtaagaaagttaaaaagctattcttttagcaattttgaaatatacatttatttttttcatttcctattgtgtgacttttttgacttttattttaagttcaggggtacatgtacaggatgtgcagtcttgttacataggtaaacatgtcataggggtttgttgtacagattatttcatccctgaggtattaatcccagtatgcattggttatttttcctgaccctctccttcctcccacccttcaccctcccataggccccagtgtgtgttgttaccctttatgtgtccatgtgttctcatcatttagctcccacttataagtgagaacatgtggtatttggttttctgttcctgccttagtttactaatgaaaatggcctccagctccattcatgtccctgcaaaggatatgatctcgtttttttttgaatggctgcatagtattatatggtatatatttaccacattatctttatccagtctatcactgatggtcatttgagttgattctatgtctttgccattgtgaatagtgctccaataaacatatgtgtgcatgtgtctttataatagaaaaatgtatttccctttaggtatatacccagtaatgggattgctgggttgaatggcatttctgtctttaggtctttgaggaattgccacacagtcttccattatggttgaattaatttacactcccatcaacagtgtgtaggcattctttttttctccacaccctcgccagcatctgttattttttgactttttcataatagccattctgactggtgtgagatggtatctcattgtggttttgatttgcatttctctaatggtcagtgacattgagctttttttcatatgcttgtttgttgcatgtgtgtcttcttttcagaagtgtctgttcatatcctttgcccactttttaatggggttgtttatttcttgtaaactcatttaagttccttatagattctggatattagacctttgtcagatgcatagtctgcaaaaattttctcccattctgtagactgtctgcttactctgttgatagtttcttttgctgtgcagaagctctttagtttaattagatcccatttgttaatttttgtttttgttgcagttgcttttggtgtcttcatcatgaaatctttgcccatgcctatgtcctgaatggtattgcctaggctgtcttccagggtttttatagttttagattttacatttaagtctttaatccatcttaagatttattcctctactctaaatgaaaaatgtacatcctttgatcaagatttatactttctccacatcgtcttcccccagtcctatggcaaccacctttatatgctgtttctgtaatgttgacttctcacttttttattttttatttatttatttttttattttactttaagttctagggtacatgtgcacaacgtgcaggtttgttacatatgtatacatgtgccatgttggtgtgcggcacccattaactcgtcatttacattaggtatatctcctaatgctatccctcccccctccccccaccccattttacatgtaagtgagatcatgtggtatttgtctttctgtacctggctaattttgcttagcataacgtcctttagtttcattcatgttgggatgaatgacaaaatttgttcttttaaagttttgtatagtagtgcactgtgcatacctatcacattttctttattcattcacctgttgatgggtacaggttgcatgtatgggttagtgcaaaagtaattgcggttttggccattacttttaattgcagcaaaagtaatggtaaaaactgcaattacatttgcaccaacctaatatgtcttggttcttgtaaataatgctgaaatgaacatgggagtgcaggtatacctttgacagaacgattttaattcctctaaaggaattaaatatataccactatatacctagaagtggaattgctgaattatatggtaattgtatttgttttgggaacttccatgctatttttctcaaacagctgtactaatttacattttcactaacaatgtataagggttcctatttctccacatcctcatcaacacttgttatcattcatctttttgataacagccattctaggaggtgtgaggtaatatttcattgggattttaatttgcatttttctgatgattagagatgttgagcattttttaatatatctattggccattcatatctcttcttttgagaaatgtctgttcagattatttgcccattctacaattggtttattgattttctaggtgttgagttgcttgagctttttatgtataatgttggatattagccctttatcagatgtatggtttgcagatattttatttcaatccatgatctctctctccactctgttattgcttcgtttgctgtaaagaacatttttagtttgatctaatccaacttgtctcttattgtcttttgttacctgtgcttttagagtcctagccaagaaatccttgcccagataaatgtcatacagcttttcttttatgttttcttctagtagctttatagtttcatttcttatatttaagtcttttacttgtttggttttataaacatatggtatgagaaagggcccaatttcattcttttgcataaggaatattcagttttcccaacaccatttattgaagagatcgtcctttcccccattgtttattctttgcacctttgctgaaaatcaattgactataaataattgggtttatttctgggctttttatccttttccattagccaatatatctgtgtttatgccaatagcatagctttatattttgaaatgacagagtattgcacctctagctttgttctttttgctcagattgctttggccatttagcatcttttttattttattcaaatgttaggattttttactatttctgtgaaaactgacattagaattttgatagggattgcattgaatctgtagattattttgggtagtatggacattttaacaatattaattcttccaacacatgaacatgaaatatattacaatttatttgtgtcttcctcagtttttttaaatcaacttatagttttcagtgtacagatcttcaactttcctggttaaatttacttcaaagtattttatttatttattttgatgctgttttaaataggattaatttcttaatttctttgttggatacctcattgttaatgtatagaaatgctactgatttttctatgttgattttgcaaactgcaactttactgaatttatgtatcagttttaacagttctcagtagagtgttcagggttttctacatataaagatcatgtcattagcaaacagagataattttatttcttgctttcttacatggatgtattttatttctttttcctgcctaattgctatggatgggatttctagtactatgtcaaaaagaagtggtaatagtcgatatccttgtcttgttcctgatcttagaagaaaagctcccaacttttcagtttttgcataatgttagccgtgggcttgtcatatatggctttattttgttaaggtacattccttccatatctgctttgttgagattttattatgaacatatgctggattttatcaaatgctttgtctgcatctagtaagatgatcatatgatttttgttcttattttgttaatgtagcatatcacatttattgatttatgtatgtttaaccatttttgcatccctcagataaatcccaagtaatcatggtgaatgatgttttaaatgtgctagggaattcagtttgctaatatattgttgtgaatttttggatctatgttcatcaagaatattggcctgcagttttcttttctggtagcatactcttagggttttcatatcagtataatactggcctcataaaatgaatttgacctccttttcaattttttggaagaatttgagaagaattcatattacttctttaaatagaattcaccagtgaccttttccttttttttttttttggttaggagacttaatttattactgatctattttctttatccagtattggtttgttcagatgtaatatttcttgatttagtcttggtaggttgcatgtttctaaagattagttcattccttctaggttattcaatttgatggtgtatggttgttcacattaatagtttatgattccttgtatttatgtgttatcagtgttagtctcccttctttcatttcagatattgtttgagttgtcttttttcccttggttagtctagttaaaggtttttcgattttatcttttcaaaaaaacaactttttagtatttgctttgtttatttctatcattatctttgttattttcttccttctgcaaagtttggggatattctgttcttctttttctaatctctaagatgtaatattaggttgtttatttgagattttccttctttctttaatgtaggcatttattactataaatttttctctcagggcttctttttctacattccatactatttgttatcttgtgtttccattgtcattgatcccaaaatattttctgtttttccgtataatttcttctttgacccattgcctgttcaggagcatgttgtttaatttccacgtaattatgagttgttcaaggttattcttattgacttctagtttcatgtcatcatgaacagaaaacatactcgatatgattttaatcttcttaaatttgttaaaacttgtttggtggcctaacatgtgatctatcctggagagtgtttcatgtgatttgagaagaatatgtattttgttgctgttggatgaactgttctataaatatctgttagatctattggattaaagtgtagttcaagccttcctctaataagaaactgcataaattatgtcaggagcaagccagggaagaagccaccttcctgttcttggtggtagagaccttccacatcttttaaaagaaagattgtggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcatgaacccgggaggcggagcttgcagtgagccgagattgcgccactgcactccagcctgggcgacagagcgagacagcgagactccatctcaaaaaaaaaaaaaaaaaaaaagaaagattgtagagttgggattgtctctggaggaagccagggaagaaggcgtggggaatgttattcctcttgtttaggctgaagaaggtttattcttcatttgctatgtagatttccaagtactggaagaggccagaaccacagggagcggctggaaaacgtgtagcctaatggtttccatggggaagttggaagatggtctgatcccaggaattaaagcttctgagagtgctcaggcagttcaaaaccccccatcgttttttgtacttgagagaaaactccaatggcttatctctgccattcctcaagcatggtgatctaaaagccaagctctgtgtcagggcctataaaagttgggttctacaaaatggaaaaccaaggcaattatgaagatgattttataatatagttcatctcttctctctttacactctagaaaaagcattttctagaaataaatacatttccttaaattaaaaaaaagttgggttctatatgtgtgctatagtttctcaacccttgggaagtagctgcaaatttggttttcttcccaaatgtaaggcactgtgctcagggtggggttagtgcatgagtgtctttccactttttctacccattttgatatgggtattttctgtcctctggtgtgcatgagtttttctactggattctgggtttctctggagagaactgatccatgtgtatgtagatgtttacttggtacgtccatgagagaaaaaatagtcataaacctcctattccacaatgttgctgaagtcacttccttcaaaagctgtaattttcttttcttacagtgtctttgtctggctttgatatgagaataattctggccccataaaatgactttcgaagtgttctttcctcttcaaagttttaagagagtttgagaagaattaatgttgtttcttctttaaatgtttggttggacttctccagagaagccgtctggtcctgtacatttcttttttgggagttactatcattatcattattattattattattattattattattattattggttcaatttgtctattcagttattctatttcctcatgattcagtcttggtaggttgtatatttttggaatttacctattccttctaagttatccaatttgttggtgtataattgttcatggtagtctctttgatccttcttattcccataaaatcagttgtaaattctcctctttcatttctggttttacatatttgagtcctctatcttttttcttagttatgcttgctaaggatttgtctattttatctttcgaaaaaaccaattcttagttttgttgactttttctattgcttttttattctctatttcacttacttagctctaatacttattatttccttccttttgctgatgttgggcttagtttgttctttttctagttcctagacatgtaaatctatattgtttatatgagatatttctttttataatgtagacatgtatctcaataagatttgcttttattactgcttttgctgcatctcataaattttggaaattgtgctttcatttttgtttgtttcaagatacttttaaattttcctattgattttttttctttgacccattgctttttcaagagagtgttgtttaatttccacatatttgtgaatttttcagttttccttctattactgacttccagtttccttccattgtggtcataaaagatatctggtatgatttcaacttcttaacagttgtcaaaacaaacttcatgacctgatatgtgatctatcctgagaatattctgtgcgcacttgaaaagatggtatattaagatgctgttgggtagcatattctgtgtgtttgtgatccatttggtctatagcgttgttcaaatccacagtttgtttatagattccatatctggctgttctgttcattattgcaagtcgggtattgatgtatcctactgttatggtgttgctgcatgtttatcccttcagatctgtcaatgattgctttacgtatttacatgctttgatgatggattcacatatatttataattgttatatcttcttgatgaattaactcttttatcttattttatgacctactttgtctcttgtgacagttttttatttaaaatctattttggctgatataattacagggtgtcctctgtgtctgtgggttttacatctgtagattcagccaatgctgattgaaaacactgtattcatggaatgtgaaatccacagatacagagggtcaaatttttttatccacaggtcctgcaagactgactgtgggacttaagcatcctcaattttggtatcccttggggttctgaaaccatgaccctgtagatactgaaggacgactgtatagccccattgctctcttttggttaccatttctacaaaatgtatcttttttatcaattaactttcaaactatgttttcttaaatctgaaacgagtatctggagacagcatataactggatcttgttttcataaatctatgcagccattgtaggtcttttgattgggaagtttaatccatttgtatttgaaataatcattggtaggtaatgacttactattgcctttttgttaaatttttctgttttgtaattctttttttctgtctttttctctcttaactgtcttcttttgtgattggatgatattttattgtgatatgctatgatttctcttttttatttctgtatttttacgtggattttccttgtggttatcatgaggcaatcacaaatatcttataatagtctactttaagctgataacaacttaacttcaatcatatatcaaaaatcttcacttttaatacctccctcacactttttgttatgtcacaatttacatctttttataatgtgtttctacaaacacatttttgtaattttagttattcttaattattttgacatttaacttttatattagaattataaatgatttatataatactattagagtattacagtattctctatttgtccatgtatttacctttactagtgagatttgtgctttcatatgctcttgtgttgctctttaccatgctttcgtttcaacttgaagaactcactttagcatttcctataagataaatctagtggtgatgaactccctcagcatttgcttgtatgagaaagtttttatccttccttaattttaaaggacagtttttccaggtatattattcttggtcagcagtttttttctttaagtattttgaatatatactttcactttatttgctcttttaaagtttccactgagaaatctgctgttcatcttaagagagctcttttggacatgacaattcagtttttttcttgctgctttcaaacttccctttcacttttggcaatttgatgatattatgtctctagtggagactttctttcttttttttccgagatagagtttcaccgtgttgcccaggctggagtgcagtagcatgatcttggctcactgcaacttccacctcgtgggttcaagcaattctctctgcctcagcctcccgagtagctgggattataggcacccaccaccacacccagctgatttttgtaatttttggtagagatgtggttttgccatgttggccaggctggtcttgaactcctgacctcaggtgatccactcccgctcagcccctcaaagtgctgggattacaggtgtgagccaccatgcccagccgagacttctttagatttgtcctatttgggattctttgagtttcctgaatttagatgttcatatctctccccaaatttgaacatattttagtcatttaaaaaatatttttacacccctttctgtcttctctgtgatttcataatgcatatattgttccacttaatgatgtcccatgaaccttcactcatttttttttttatttcttcttgctccactgactggataattttaaatgatctacctttttttttttttttggtgtccatcttttgagggttttttaattttattttttatttttttatttttattttttattatactttaagttttagggtacatgtgcacaacgtgcaggttagttacatatgtatacatgtgccatgttggtgtgctacacccattaactcatcatttaacattaggtatatctcctaatgttaggtatatccccctcctccccccaccccacaacaggccctggtgtgtgatggtccccttcctgtgtccatgtgttctcattgttcaattcccacctatgagtgagaaagtgcagtgtttggtttttttccttgcgatagtttgctgagaatgatggtttccagcttcatgcatgtccctgcaaaggacttgagctcatccttttttatggctgcatagtattccatggtgtatatgtgccatattttcttaatccagtctatcattgttggacatttggcttggttccaagtctttgctattgtgaatagtgccgcaataaacatacgtgtgcatgcgtctttatagcagcatgatttataatcctttgggtatatacccagtcatgggatggctgggtcaaatggtatttctagttctagatccttgaggaatcgccacacggacttccacagtggttgaactagtttacagtcccaccaacagtgtaaaagtgttcctatttctccacatcctctccagcacctgttgtttcctgactttttaatgatcaccattctaactggtatgagatggtatctcattgcggttttgatttgcatttctctgatggccagtgatgatgagcattttttcatgtgttttttggctgcataaatgtcttcttttgagaagtgtctgttcatatcctttacccagtttttgatggggttgtttttttcttggtttgttgattctttctccagtttgatcaagtctgctattgaatcctctagggagttttttagttcaattattgtattcttcaattccagagtttttactgatatttgactttttgtgtgtgtgtgtatagtttctttcccttcattgatatcctcattgtgttcatgtatcatcttcctgattttgtttagttgtctatctctgttctctggtactttgctaaacttcattaggataattattttgaattcttttttaggcaatttataaatctctatttctttagggtcagtaactgcggatttcttttatccctttttgttgtttccctaattctttgtgttccttgtgctttgcattggtgtctgtgcattggaagaatagccacctgtcagccatccgacacaatgtcacaaaggacacaaaacagccaccaagatttatggactgactttgacagggcaagacctttgccagtcagcctggctagagatactgagagtctctcaaacagctaatctaccgtccccttttcctatgtttgtagctgtatcaattgttctaatcatactggttctttcagtgctccatatgaggcaagagtgaaactggaccctagtgcagcacactgaatggcaaggacatttgatgtgctccactcctctccctcccttgaaagtggtatcttgatgaaaatgaataaattagcccctagaaaggatggataaattgtttcaaaccaagtaacaggataccagcacagttatgattgaaatgcctgtttgatttgaaaacccatatcttttccacaatgcaatgttgccacttactgctttttaacttcaataatttgatcaaagcttatggctctatcaactacccatgcctctttctaataaccaaccctattttactagtttttccaactattcatcatcctcataagtacttttttcacctctaatgatttcatgtgaaattagtttttaataatcataaaacatactactattagaacaaaagtcattaatgagttcaagttataaaaaggaagattacatgatatacaaatatataattacaaatttgagcaactatggagtaaatgttaacaataacctcatttcattaactctcatcttatcaggaagtttaatagcaccaacagtaatagtaactaaaatttaatgaagacttaccatgtgccagatattatgctaagtattcttcatgcattacctcaatttatcttctcagcaaacacaaatgcagtgactactcttataatgatgaggtggttttacttaaagaattaagaaacttacccaaggacaaaagaaaggacttgaacaaagatgatctgacaccagaagtgaagaagtctttattactatgtaatacagcctcaatgtagattgtaacacagaaaaaaactagcctgacttacagaattccttccacctaggttttaaagggatacattttgcacaaggcctaaataagctataggaaaacaaaacacccacgcaagtttctctattgaattaattcataatctcctattagttttatcccattcttcatcatattgacaaccaggatatcattaggggaaaacaaaatctattactttgattttctcttcaaagttggagttttctcctcagtttttctccagcttcttctgtcaagttcttggcatgctgtaattttcagtccccattaatgaacagtaaaggatctgggtttctcttgacattgacatgaagtctgtctctctcatgccttgccagtaggtgagatgaatatgaaaattacataaagactgcatattaaatagaggaaagctgaattaaaacactctaaggtggccggatatggtggctcacgcctgtaatcccagcactttgggaggccaaggctggcagatcacttgaggccaggagttcaaaaccagaccagccaacatggtgaaaccctgtctctactaaaaatacaaaaattagcctgatgtggtggcatgcacctgtaatcccagctacttgggaggctgagacatgagaattacttgaacccaggaggtggaggttgcagtgagccaagatggtggcactgcactccagcctgtgcctcagagcaagactccatcaaaaacaacaacaacaacaacaacaacaacaaaaacactctaaggcagaaagggaagtctggttaccattaggtgtttgatgaataagaaaattcaatataatgggaagcttcccattcaatagcaaacaattaaaaaaataagtaaataagaggaagctgaatattaccaaatccaagagaataaagggaaaccataaccaggtcatctttaattccagcaccctacaagttaagtaatgatctcagaactataaatccttgaaaataaattcttaattatatggattatactaatttatgctgtgacttaaaaaggtgaaattatagactaatgtagaatatacataaatctgtaaaacttacagctaacttaagaaattagcagagaacaaagggagcaactgaagcttctagcccccctttgtaagatttaggcttttccagtcaaaaacctcatttagatgttatgttatttactgttgaattttaaaagttatattttcttttatgtaatcaattggaaagtccttcagtttgggtatgataattgataacttcctcagtacctagaaatctatcaaggataatgttgacatccaataaagtgtttatgttgaaatcctttatttagaattaaaaaggtagtcaaagagtttcttgaaatagagatatagaaatgtatattatcattttagtttatattcattttttatgtaaaggaataatggtatattaaaatgaatataaaattaatacaattttggttattgtatgtagcccctattctttttttattattatactttaagttctagggtacatgtgcaaaacatgcaggtttgttacataggtatacatgtaccatgttggtttgctgcaccaatcaactcatcatttacattaggtatttctcctaagtaatccctcccaaagctcccaaccccctaactgcccctggtgtgtgatgttcccctccctgtgtccatgtgttctcattgttcaactcccacttatgagtgagaacatgcagagtttggttttccgtccttgtgatattttgctgagaatgatggtttccagcttcatgcatgtccctacaaaggacatgaactcatccttttttatggctgcatagtattccatggtgtatatatgccacattttctttatccagtctattattgatggacatttgggttggttccaagtctttgctattgtgaatagtgctgcaataaatatacatatgcatgtgtctttatagtagcatgatttacaatcccttgagtatatacccagtaatgagattgctgggtcaaatggtatttctagttttagattcttgaggaatcatcacactgtcttccacaatggttgaactattttacactctcaccaacagtgtaaaagcgttgctatttctccacatcctctccaacatctgttgtttcctgactttttagtgattgccattctaattggcatgaggtggtatctcattgtggttttgatttgtgtttctctgatgaccagtgatgatgagcattttttcatatgtctgttggctgcataaatgtcttcttttgagaagtacctgttcatatcctttgcccactttttgatggagttgtttgtttttttcttgtaaatttgtttaagttctttgtagattctggatattagcccttttgtcagatggataaattgcaaaaattttctcccattctgtaggttgcctgttcactctgatgatagtttcttttgctttgcagaagctctttagtttaattagatcccatttgtctgttttggcttttgttgccattgcttttggtgttttagtcatgaagtctttgcccatgcctatgtcctgaatgatattgcctagagtttcttctagggtttttatggttttaggtcttacatttaagtctttaatccatcttgagttaatttttgtacaaggtgtaaggaagggatccagtttcaactttctacatatggctagccagttttcccagcatcatttattaaatagggaagcctttccccgttgcttgtttttgtgaggtttgtcaaggatcagatggttgtagatgtgtagtgttatttctgaggcctctgttctgttctgttggtgtatgtatctgttttggtaccagtaccatgctgttttggttactgtagccttgtagtatagtttgaagtcaggtagtgtgacgcctccagctttgttctttttgcttaggattatcttggctatgcaggctcttttttggttccatatgaactttaaagtagtttttttccaattttgtgaagaaagtcagtggtagcttgatggggatagcattgaatttataaattaccttgggcagtaatgccattttcatgatattgagtcttcctatccatgagcatggaatattcttccatttgtttgtgtcctcttttatttcgctgagcagtggtttgtagttctccttgaagaggtccttcacatcccttgtaagttggattcctaggtattttattctctttgtagtaattgtgaatgggagttcactcatgatttggctccctattctttataaaagttctaaatatttgccaaatcatcaaagaagatattcattacttttaattcttacaaattttcttagcaataaaagtcacagtaagacagctagcagataaaaaagataaaagtacatagtttaaaacaacactgattagcacaccaaaagaatattgagccaatccttattatatgtaatacaaatatttatatatgcacatttaactgtgtttggagacccatgtttctacacatatgtaattatttaagatatattttatgtatagctatcatgaacataataaaatacattttatttctatattaacacattttaacctattttagtaatctatagaaagatgtagacaatgattctggttttaactacatttattttttgtttgtttctttaccttggaggtcaagacatctttatgacagaagaacagaagaaatactataatgcaatgaaaaagctggggtccaagaagccacaaaagccaattcctcgaccaggggtaaaaaaatatatatatctttagcatatagattttcaaattatttctaattcatttttaatgcacatctttaatttctggataatacttgaaaagtttactctgcattcgatattattcttatttctttgcagaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtaagaatatttatttttcagattttattttttgagtaaagctaaacttcacttatgctcaaggaagtatatgctgaattcttgaacacaaatttactcttgagtaagtcagtacaatgaaagaatgaaaaaatcctaaaaagcaaaacaaatatctgtctctcatactacagtgtttctgggtttacactacaggccccaaagccaaatatttctatctattagaaggaaattatacttgttgatatttagtttccaatattacctttgcaaaactagttaccatgtttatatatagctgtgtcttggaaaaccaatgttgaatctgaaataacttctggttttagcacatgtgagacttgtcatttgattaatgataatattaatagccagaatatctgtgaatttgtgaaaattcttccagaatttaaagtgaagttaagatctctagaaatgccagttttattttttacagcttaatacttcacaagtgtataaaatgccaatcattcctcaaccagccatggtgttcatgtctgtgaataacagcacatgattttatacttcctatacattcattgccatggttgtttttctatcttcttgtttttgttgttgttgttattttcacatatcttgcaaagtattttaggattgtatttctttttagaattataaacttttaagagagagagattatagagattactacaagtttaatcaacaggttatcaatctgaaaaggttcaaggttgcatgacttagaatcataaaattgagtgccacataacagagtaagcatttaaaatcaataattttggaaaagcatattatcaccagaagtcataccaaaattgatataagaaaatgtattaaaatttaggtgagaatttcacactaacaaaaatgattctgaaagcattcctattaagtcaggaaaaaaaaaagagtgtgcctgtatcatccctgtttttagtgttgttggccaatgcaattagataagaaaacagagaggtacatatataaaaacaatggagtaaatgatccttaatataatgaccttcttcatataatgaaagaacttgttcatatattgaaagagaatcaactaaaaataaattcaattagagttcaaaaggtacaaattttaaattacatgtgccaacactaataattatcttatacatgaaaaaaattagaaaatctgattcacaattgcaataaaaataaagtaaattatctaataataactttatcatatgagacttctgaagaaaactttaggatataaaagaaagctaaaataattgaaaggattgtcatgtacttagataagcttctctcattgtaattaagactttcaaatttattaatctataaattcaaggaaaatatcaatgagtctttttatgtagtgtgggtaataaatagacaaaaacaatataagtctaaatgattctaaattcatctggaagaaaattagggtgacaagaggtggcttattctgcaaaatattaagacatatagatgttaaataaaactgttcaaatataaaagctcagtgggtttgaagagagtccaaattaaactttaatgtataattaccaatttactgtgtgaaaagatcacatgaatcaaaatctaaagttaaaaaaaaagattctagtaggaaatatgtggaaatagacatataaccatatactcttatagtcctttctatgcaaaacacaaatttgtaaagccaaaaaaaaaaatgaagaagaaatgactgcacaaaaaaacaaaatattctttggggaaaaaatcatcataaataaaaggttgaaagacaaaaaataggtgaaatgtttacataacagttaaggccgagaaaggatcaatactttaaatagaaaattgttcttataaattaataagaatatagtaaaaatcccaatagacacatgggcaaataccaaactaagccaaaaacagaagttaaaaacaaccaataaggatacaaaataacaaaacacaaggaaaattgtggattattttcacaaaaaatgcaaataaattacaatagtagatgttttcaaatgtcatgaaaattttttggtaaaaaactataaagaagaatggtagcactcaatactgttgaatgtgtaaagtatgagcactatcatatactgccattagaaatgttaattagtacaggctttctggagataggttcagctatatattgtgtgtatatatatacacatacacacacatactatgtatatagtatagagtatgtatatatgtatactatatatatacatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatagtatatgcatactatatgctatatagcgtatatgcatactatatgctatatagagtatacgcatactatatgctatatatacatactatatagtatacatatactatgtactgtatatacgtatacttagtatatgtatatgtatatgtatagtatatgtatatgtatagtatatgtatactatatactgtatatagtatatatagtatgtgtatatatatagtatgtgtgtatatatagtgtgtgtatatatataaacatatatatactgttgacccaagttctattaacatattattaaaaagtactcatgcaattaggagaacatagctatttagatattcatttcagtaacaaaaatggaaacagtataaatgctagtcttcaatttgtggttattttgagagaacattataccactataataaattatttcgttgtcatttttatgaaactatctccatgacatataaagtaaataaaataggttacaggctgggcactgtggctcacgcctataatcccagcacattgggaggccgaggtgggcgaaatcacttgaagtcagaagtttgagaccagcctggccaacaaggtgaaaaccgtccctaccaaaaacacaaaaattaaccaggtgtggtggcgcatgcctgtagtcccagctactctggaggctgaggctggagaatcatttgatcccgggatgcagagattgcagtaggccaagatcacaccaccgcactccagctttggcgacagagcaagactctgtcttgaaaaataaataaataggttacaaaaaaagcttatataacatgaatacatttgtttgtgtgtgtacatgtgcttgcacagaaaaatgtctgaagtgatactcaaaaaaatattgataatagttattgttgacatttcaggtgatttatattttctttttagcatttaacggtattgcttgaattttctatgtgagtaggtatcattcttaaaatgtaaaacactattatggagggaaaaaatggcccatgaacttagtaaaaaggagaaaatgtcacaatggtaatgttagtcatttctctttggaatttcttaatccttttttaagtaattgcattcagtataaaataactgtcttggccgggcacggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaaaaactgtcttgaattcataagaaatgagttgacagataaaactgtttagagtcatcatttcaggtagcatacatctttaaatattttatttctattattttcctccacatacaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggctattcatttctacaaatgtttttcattcatcttgactcacatgccaacaaggataagacttacctttagagtattgtgtttcatagcctttcttctttcatatccctttttgttcatagaataaccacagaacttgaaaaattattctaagtacatattacactcctcaaaaaaaacaaagataactgagaaaaaagttattgacagaagttctatttgctattatttacatagcctaacatttgactgtgctgcccaaaatactgataatagtctcttaaactcttttgtcaaattttcctgctttcttatgcagtattgtttagtcatcctttcgctgtaagcaaagttgatgaaatccttcctgatatgcagttagttgtttgaccacggtacatacttgagcagataataacttgggcacagtatttattgcatcacttgtatacaatcccgtgtttggcaagctttcaaatcatgtaatatgacagactttacacagatatgtgtttagtatgaataaaaaagcattgaaatagggattcttgccaacttgctctcttgccaccaacttactttcctaaattatggaagtaatcttttttggatatacttcaatgtatacaatgaggaagatgtcaccttctccttaaaattctatgatgtgaaatatattttgcctcaatcaacacagtaccatgggcttctaatttatcaagcacatattcattttgcattagctgtagacatctagttttttgaaaacacctattaatagtaatttgaaaagaaataaccataatgctttttttcgtgagtttatttcaggaatatgagatctttcttctataaagttattcatgcacaggcaaaaattgagctacacaggtagaatgtagttttacttagaagatttttgtgggaggttttgaagcaaatatataaaacaactttcactaatttgctttccatatttaaaaaataataaattacatttatataataaatgtttaaagcacatattttttgttgttctggcaatttaaaaagaaagaggatttaaacgtacctatagaaacaaagatttatggttaaagaatgagatcagaagtctagaatgtttttaaattgtgatatattttacaacatccgttattactttgagacatttgtcctaatctacgtataaaactcaatctagggctaaagattctttataccatcttaggttcattcatcttaggctatttgaaccactttttaatttaatatgaaagacaccatgcagtgttttccgagactacatagatcattttatcacatacctaccaagcctgttggaaataggttttgataatttaagtagggacctatacaaaatatattacatttatcagatttttaaatacattcaattaagaatttaacatcaccttaaatttgaattcaatctaccgttatttcaaactcacaaatataactgcattatgaatacttacataatgtagtaagacaagatgtttgacaggttcgtgtgtaattttctattaatgtttttacattgccttgtttttatgtaaaataaaaaatatgggcaactggtttgttaacaacacaatttcttcttagcatttcaaaaatatatataaagttgttctttttcctatttcatgaactatgtttttttttaaaataacatggttaagttttatatatatttacgtttgtttcaggaatgtctacttgtgactttttatcaattaaaaataatatttggaagaaagagcttattaagtataagcttgaagtaaaattagacctctctttccatgtagattactgtttgtactgatggtttcacccttcagaaggcactgtcatattaatatttaaattttataatcgctgaacttattacacccaacaatacagaaaggcagttacactgaagaacttaacttagaataaaatggaagcaaacaggttttctaaaaacttttttaagtgaccaggtctcgctctgtcacccaggctagagtgcaatggcatgatcatagctctctgcagcctcaactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatctttcggatgaaaattagagaacctaattttagctttttgatagttacctagtttgcaaaagatttgggtgacttgtgagctgtttttaaatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttatacaaaataaaattatgtttacacgtattttctgtttcagttagaataaccataggtgggtaaagtcagtggatatctaaataagttgcaacaactgatagctttttccttttcattgaaaggacagcttcaaatgtcctccataagaagtgttcccgggaaacaaagacaaggacaaagaatctagagttccaaagtaatttcttgaaatccacatcaaggtttgtgcaaagggagaaaattgagacaggaagcaaaaatatgcaaacatctagccacacagcgatgtctacatttttgtgtaatagcattaagaggtggtgtagcatacataatggctaagagctttggttcatggagactgcattgttcctgtatgacacagaagtagcctggattcttacatttttagtagcaaattggttgtcatactaactactattactactaatataaattcttgattctgtattgtcattgttctaatttctttgtgtagcttgtctcattctacccttacaaccacatggagtattactctttttctcattttacagatgggaaagctgtaccagctcttaagaggtgatatagcatacataatggctaagagcatgggttctaagactagaactatatttgtatcccagttaagccatgaccctatgagtttgctgaatacattctttaacctatatgggcctcaactttcttatctataaaatgaggagaagagtactacttcattatgtggttgtaatgatagaatgagacaagcttcatgaagaaattaaaacaatgactgaaaacacattgaaaatttatattagtagtaagagtagttagtatggcaattaatttgctactaaaaatgtaagaacccaggctacctctgtatcatacaggaacaatgcactcttcatgaatgttaaataatgacaatattttctctattttatatgggtaagtataactatagtgcccaaaagagttttatgcacccattggtaggtagtaaatatttagtgatgtggcatatacaccaaatatttcaaaatttagctacttttgagatttatgaattcaaacaacatattaaaatcaggaaatatgcacatttataaaggtctagcttatttccaaaaagtggaggtggttcttaccatttttagctgagtaattaatacaaccctctactttagctataagcatcaagtcctgttgatggtcattaggtaagatattctaaaaataattgccatactaggccattatttcaacttttatgttatcttaatagcatgtaaaaggtgtaaaatagtccttgggacttttgtactgatagttgcaatagccactctgcaaaatagaattataatcactgaataatactgtaatccatttcaacataagtgattgtgatacatgcaaattttttacaacaacaaagctaaattctttcacattgtagataatgctatgccataacccaagcaaaatgagctgcaggatacatggtaatctctctcaagggagggagaaattacatactagctagagcagaggggattttgctgcaatagtatttgatgcacacaggaaatgaaacatgaataattgatagttataaacaagcaatagagctcacatgctacacttagcttgactccctattactctgcgagccatacctacattaataattgatctgtctgcgaaaaggtaatttgaagagatttatgagacattggtaataactgcatcattgcactttagcttgaatctttttaaatatatctttagaaacaaaagataaaagcaatgcacaataagtatacagaaaatgttcagagcttgttaaaaattttgcaaatctagtagaactgagcaaaagttattcgtaagttgtaatatttgctggcatgacctagtttttattttatttcctacaaaacaatatgtcttcaagttagttcagtcatattctttctataaaaatataattcttctctaatataccatcataattcatttttatttttagtgatgtgtaaaatttagaatttatgggaaaattatatccagtgaatattaagaatacactcccattaaattactatttctaaatatgtgagaacataatctggatttgcatgtgctgctttaaacaaatacattcttttacttatggctggcccttcatctgaggagcctccagatttactctctttaaatatcttgtgtcttctactctgtacattgacaatatgttaaaatgtgctttctcctgttcttaggctactcttgagaactgctcatttttatatgagaaagaatgatatcttgctcatataagaaaaggatataaaccaactgtgatacactaattccttctaacagaacagaaaaaataagtggatggggttacatgtgtctttatacaaaacacagataactatacccaggctcctgcctcacaaaaattgtgagataatacatttgtattattttaagctgctaaatttgtgatcatttgttacaaaggatcaaacacaaatgcatgctcctgttttccaatgtaccatgttaaggtagaaatacagatgagcaacgctactagaaaggttattttatcaaaccacaatggctcatacagactgtggaggtaaaaagagagggacactggtgagacagtttggcacactgatctcgcccgcaaaagactgatgtagaaagcaaatgttaattgttatcttatcaaaaatttaaaggaggagattttcctccctgttgactatcctaatcgtgtttaccattcagtgcaccttattcttggcaaagcaccttacaaatttttacccagaagccaaagaaaatgggcaatcttaagtaattttctcaaagtcaaagagaatctgaagtatacttgtcccactcatgcctttaaaatgtaggccaagagaatctacagcaaatgtcttctaaaacgtttcatttggaacataaaaagtttctatgtcaatacatttaaggaagggtgcattatatatttcactcttagagtaacataattcactttagcatgttacatgcttgcagaagacatgagactcaggagtcagagataataatagattattacttaaagcaatagcaggagccagagtattatcatttttgtgttggtcttagaaagctggggctgtcataataatataccatagactgggtggctagaacaacagaaatttatttctaacagttcccgaggctgaggagtccaagattaaggcgccagccaatttcgttccccagtgagggctcatttcctggctggcagagggcagcattctcactgtgtcttcaaatggaggaggcagtgagctctggtctctcttcttttttctataggaatactaatctcatggtggaagatatatatatatatatatatatatatatgtatatatatatgtgtgtatatatatatatatacatatatatatatgtgtgtgtatatatatatatatatatatatatatatatatatgcattcagtcctccatatccatggtttctgatctgtggattcaaccaattctggatcagaaatagttggggaaaaaatccacaaagccccaaaaggcaaaacttgaattttccatatgctgagtactacattgaatccatacaaatgaagtgatgtgtaggtaattttaaactatataggaggatgtgtgtaggttataagcaaacactatgccatttgtataagagatttgagcatctgtggattttggtattctcagggagtccagaagccaatccccagcagatactaagggacaactgtatatcatggtaaataaattacatcttccttctcattgattagtaccaccattcatccagttttccaaactaatcctcttcattaaccctccgcatttattcaccaagaccagttcattctaccacctaatgtaatgtaaatacatcaacttctcttaatttccactgtcaacacctaatccaatccattaccacctttaacctctttataagacaatgtaataacctacttgttttatcttactaaatccattcttgcctcacttccaaatctattctcagtacagtagccagagtggattttatgaggttgtgacatttccctgcttaaaattttgggtcattttccggcataaaattctgtaatatttctccattattatgatgataaattctaaaatcctcagcaaagattttacaaactctatactattactgtctacaagttctacaagctttccagccctacaccatgtcagcctcactgctcttatcttccctctttccctatcttaatctgtgtgcttcagcctcaatagttttctttctgtttgcaggatcttctcaacaaaagtatagtgtattcttacattcttatacagtgccagtgctttctggcctgagagagactatacatgtctttcacatggtaagttgagtggatgtttgaaactgtcccactgctcacaaaataaaattagtatagaaaactggcatttttgaaggactaagttaaaagtgtttttcctctatagctttaacaaagtagaaaaaaaacagagataatgtcaagtaggaaataaagactgaaaaatgaaaactttcatatacattctacattaaaatcagacatttatttctctaaggcctgagtttctcaatattggcaatcttgatatttgagctggataattctttgttgtgagtggctgtcctgtgcatggtgggatgtttagcacgatcactggtctctaacctctagatatcaataaacattcctaattccacagttatgacaaataaaaatgtccccatctttgctaaatgttctcagggggacaaaatcttccccagttgacaacgactgatctctgacaatgtctataaaagtatgaatcatggataaccgacattaccttagctattagttt

SEQ ID NO: 5305 - DNA, 20 bp, Artificial Sequence
  Description of Artificial Sequence: Synthetic oligonucleotide
  Target: SCN9A; (-) strand; PAM type: NAAAAC; PAM sequence: GAAAAC
ggaaataaagactgaaaaat

SEQ ID NO: 5306 - DNA, 20 bp, Artificial Sequence
  Description of Artificial Sequence: Synthetic oligonucleotide
  Target: SCN9A; (-) strand; PAM type: NAAAAC; PAM sequence: AAAAAC
tagctttaacaaagtagaaa

SEQ ID NO: 5307 - DNA, 20 bp, Artificial Sequence
  Description of Artificial Sequence: Synthetic oligonucleotide
  Target: SCN9A; (-) strand; PAM type: NAAAAC; PAM sequence: GAAAAC
cacaaaataaaattagtata

SEQ ID NO: 5308 - DNA, 20 bp, Artificial Sequence
  Description of Artificial Sequence: Synthetic oligonucleotide
  Target: SCN9A; (-) strand; PAM type: NAAAAC; PAM sequence: CAAAAC
atccacaaagccccaaaagg

SEQ ID NO: 5309 - DNA, 20 bp, Artificial Sequence
  Description of Artificial Sequence: Synthetic oligonucleotide
  Target: SCN9A; (-) strand; PAM type: NAAAAC; PAM sequence: TAAAAC
aatctacagcaaatgtcttc

SEQ ID NO: 5310 - DNA, 20 bp, Artificial Sequence
  Description of Artificial Sequence: Synthetic oligonucleotide
  Target: SCN9A; (-) strand; PAM type: NAAAAC; PAM sequence: CAAAAC
gggttacatgtgtctttata

SEQ ID NO: 5311 - DNA, 20 bp, Artificial Sequence
  Description of Artificial Sequence: Synthetic oligonucleotide
  Target: SCN9A; (-) strand; PAM type: NAAAAC; PAM sequence: CAAAAC
agtttttattttatttccta

SEQ ID NO: 5312 - DNA, 20 bp, Artificial Sequence
  Description of Artificial Sequence: Synthetic oligonucleotide
  Target: SCN9A; (-) strand; PAM type: NAAAAC; PAM sequence: GAAAAC
aagaaattaaaacaatgact

SEQ ID NO: 5313 - DNA, 20 bp, Artificial Sequence
  Description of Artificial Sequence: Synthetic oligonucleotide
  Target: SCN9A; (-) strand; PAM type: NAAAAC; PAM sequence: TAAAAC
gacaagcttcatgaagaaat

SEQ ID NO: 5314 - DNA, 20 bp, Artificial Sequence
  Description of Artificial Sequence: Synthetic oligonucleotide
  Target: SCN9A; (-) strand; PAM type: NAAAAC; PAM sequence: GAAAAC
tatgttattatcttcttgag

SEQ ID NO: 5315 - DNA, 20 bp, Artificial Sequence
  Description of Artificial Sequence: Synthetic oligonucleotide
  Target: SCN9A; (-) strand; PAM type: NAAAAC; PAM sequence: AAAAAC
tggaagcaaacaggttttct

SEQ ID NO: 5316 - DNA, 20 bp, Artificial Sequence
  Description of Artificial Sequence: Synthetic oligonucleotide
  Target: SCN9A; (-) strand; PAM type: NAAAAC; PAM sequence: TAAAAC
catttgtcctaatctacgta

SEQ ID NO: 5317 - DNA, 20 bp, Artificial Sequence
  Description of Artificial Sequence: Synthetic oligonucleotide
  Target: SCN9A; (-) strand; PAM type: NAAAAC; PAM sequence: TAAAAC
gaggttttgaagcaaatata

SEQ ID NO: 5318 - DNA, 20 bp, Artificial Sequence
  Description of Artificial Sequence: Synthetic oligonucleotide
  Target: SCN9A; (-) strand; PAM type: NAAAAC; PAM sequence: GAAAAC
ctgtagacatctagtttttt

SEQ ID NO: 5319 - DNA, 20 bp, Artificial Sequence
  Description of Artificial Sequence: Synthetic oligonucleotide
  Target: SCN9A; (-) strand; PAM type: NAAAAC; PAM sequence: AAAAAC
tacatattacactcctcaaa

SEQ ID NO: 5320 - DNA, 20 bp, Artificial Sequence
  Description of Artificial Sequence: Synthetic oligonucleotide
  Target: SCN9A; (-) strand; PAM type: NAAAAC; PAM sequence: GAAAAC
ataaatcagaagaccatgta

SEQ ID NO: 5321 - DNA, 20 bp, Artificial Sequence
  Description of Artificial Sequence: Synthetic oligonucleotide
  Target: SCN9A; (-) strand; PAM type: NAAAAC; PAM sequence: TAAAAC
aagtgatttatttgtgttaa

SEQ ID NO: 5322 - DNA, 20 bp, Artificial Sequence
  Description of Artificial Sequence: Synthetic oligonucleotide
  Target: SCN9A; (-) strand; PAM type: NAAAAC; PAM sequence: AAAAAC
aatgagaactcaagtccaga

SEQ ID NO: 5323 - DNA, 20 bp, Artificial Sequence
  Description of Artificial Sequence: Synthetic oligonucleotide
  Target: SCN9A; (-) strand; PAM type: NAAAAC; PAM sequence: TAAAAC
tgaacccatcacaaccacac

SEQ ID NO: 5324 - DNA, 20 bp, Artificial Sequence
  Description of Artificial Sequence: Synthetic oligonucleotide
  Target: SCN9A; (-) strand; PAM type: NAAAAC; PAM sequence: CAAAAC
ggatcctcctcttctcatag

SEQ ID NO: 5325 - DNA, 20 bp, Artificial Sequence
  Description of Artificial Sequence: Synthetic oligonucleotide
  Target: SCN9A; (-) strand; PAM type: NAAAAC; PAM sequence: TAAAAC
ataagaaatgagttgacaga

SEQ ID NO: 5326 - DNA, 20 bp, Artificial Sequence
  Description of Artificial Sequence: Synthetic oligonucleotide
  Target: SCN9A; (-) strand; PAM type: NAAAAC; PAM sequence: AAAAAC
aaaaaaaaaaaaaaaaaaaa

SEQ ID NO: 5327 - DNA, 20 bp, Artificial Sequence
  Description of Artificial Sequence: Synthetic oligonucleotide
  Target: SCN9A; (-) strand; PAM type: NAAAAC; PAM sequence: TAAAAC
taggtatcattcttaaaatg

SEQ ID NO: 5328 - DNA, 20 bp, Artificial Sequence
  Description of Artificial Sequence: Synthetic oligonucleotide
  Target: SCN9A; (-) strand; PAM type: NAAAAC; PAM sequence: AAAAAC
aggtgaaaaccgtccctacc

SEQ ID NO: 5329 - DNA, 20 bp, Artificial Sequence
  Description of Artificial Sequence: Synthetic oligonucleotide
  Target: SCN9A; (-) strand; PAM type: NAAAAC; PAM sequence: GAAAAC
accagcctggccaacaaggt

SEQ ID NO: 5330 - DNA, 20 bp, Artificial Sequence
  Description of Artificial Sequence: Synthetic oligonucleotide
  Target: SCN9A; (-) strand; PAM type: NAAAAC; PAM sequence: AAAAAC
gtcatgaaaattttttggta

SEQ ID NO: 5331 - DNA, 20 bp, Artificial Sequence
  Description of Artificial Sequence: Synthetic oligonucleotide
  Target: SCN9A; (-) strand; PAM type: NAAAAC; PAM sequence: CAAAAC
ccaataaggatacaaaataa

SEQ ID NO: 5332 - DNA, 20 bp, Artificial Sequence
  Description of Artificial Sequence: Synthetic oligonucleotide
  Target: SCN9A; (-) strand; PAM type: NAAAAC; PAM sequence: AAAAAC
ctaagccaaaaacagaagtt

SEQ ID NO: 5333 - DNA, 20 bp, Artificial Sequence
  Description of Artificial Sequence: Synthetic oligonucleotide
  Target: SCN9A; (-) strand; PAM type: NAAAAC; PAM sequence: AAAAAC
ggcaaataccaaactaagcc

SEQ ID NO: 5334 - DNA, 20 bp, Artificial Sequence
  Description of Artificial Sequence: Synthetic oligonucleotide
  Target: SCN9A; (-) strand; PAM type: NAAAAC; PAM sequence: AAAAAC
aagaagaaatgactgcacaa

SEQ ID NO: 5335 - DNA, 20 bp, Artificial Sequence
  Description of Artificial Sequence: Synthetic oligonucleotide
  Target: SCN9A; (-) strand; PAM type: NAAAAC; PAM sequence: CAAAAC
ctcttatagtcctttctatg

SEQ ID NO: 5336 - DNA, 20 bp, Artificial Sequence
  Description of Artificial Sequence: Synthetic oligonucleotide
  Target: SCN9A; (-) strand; PAM type: NAAAAC; PAM sequence: TAAAAC
taagacatatagatgttaaa

SEQ ID NO: 5337 - DNA, 20 bp, Artificial Sequence
  Description of Artificial Sequence: Synthetic oligonucleotide
  Target: SCN9A; (-) strand; PAM type: NAAAAC; PAM sequence: AAAAAC
agtgtgggtaataaatagac

SEQ ID NO: 5338 - DNA, 20 bp, Artificial Sequence
  Description of Artificial Sequence: Synthetic oligonucleotide
  Target: SCN9A; (-) strand; PAM type: NAAAAC; PAM sequence: GAAAAC
tatcatatgagacttctgaa

SEQ ID NO: 5339 - DNA, 20 bp, Artificial Sequence
  Description of Artificial Sequence: Synthetic oligonucleotide
  Target: SCN9A; (-) strand; PAM type: NAAAAC; PAM sequence: AAAAAC
aaacagagaggtacatatat

SEQ ID NO: 5340 - DNA, 20 bp, Artificial Sequence
  Description of Artificial Sequence: Synthetic oligonucleotide
  Target: SCN9A; (-) strand; PAM type: NAAAAC; PAM sequence: GAAAAC
tggccaatgcaattagataa

SEQ ID NO: 5341 - DNA, 20 bp, Artificial Sequence
  Description of Artificial Sequence: Synthetic oligonucleotide
  Target: SCN9A; (-) strand; PAM type: NAAAAC; PAM sequence: GAAAAC
ttatatatagctgtgtcttg

SEQ ID NO: 5342 - DNA, 20 bp, Artificial Sequence
  Description of Artificial Sequence: Synthetic oligonucleotide
  Target: SCN9A; (-) strand; PAM type: NAAAAC; PAM sequence: CAAAAC
agtttccaatattacctttg

SEQ ID NO: 5343 - DNA, 20 bp, Artificial Sequence
  Description of Artificial Sequence: Synthetic oligonucleotide
  Target: SCN9A; (-) strand; PAM type: NAAAAC; PAM sequence: CAAAAC
aatgaaaaaatcctaaaaag

SEQ ID NO: 5344 - DNA, 20 bp, Artificial Sequence
  Description of Artificial Sequence: Synthetic oligonucleotide
  Target: SCN9A; (-) strand; PAM type: NAAAAC; PAM sequence: TAAAAC
tttcactggagaatgtgtgc

SEQ ID NO: 5345 - DNA, 20 bp, Artificial Sequence
  Description of Artificial Sequence: Synthetic oligonucleotide
  Target: SCN9A; (-) strand; PAM type: NAAAAC; PAM sequence: TAAAAC
aaagataaaagtacatagtt

SEQ ID NO: 5346 - DNA, 20 bp, Artificial Sequence
  Description of Artificial Sequence: Synthetic oligonucleotide
  Target: SCN9A; (-) strand; PAM type: NAAAAC; PAM sequence: CAAAAC
taagttctagggtacatgtg

SEQ ID NO: 5347 - DNA, 20 bp, Artificial Sequence
  Description of Artificial Sequence: Synthetic oligonucleotide
  Target: SCN9A; (-) strand; PAM type: NAAAAC; PAM sequence: AAAAAC
agatttaggcttttccagtc

SEQ ID NO: 5348 - DNA, 20 bp, Artificial Sequence
  Description of Artificial Sequence: Synthetic oligonucleotide
  Target: SCN9A; (-) strand; PAM type: NAAAAC; PAM sequence: TAAAAC
gtagaatatacataaatctg

SEQ ID NO: 5349 - DNA, 20 bp, Artificial Sequence
  Description of Artificial Sequence: Synthetic oligonucleotide
  Target: SCN9A; (-) strand; PAM type: NAAAAC; PAM sequence: AAAAAC
acaacaacaacaacaacaac

SEQ ID NO: 5350 - DNA, 20 bp, Artificial Sequence
  Description of Artificial Sequence: Synthetic oligonucleotide
  Target: SCN9A; (-) strand; PAM type: NAAAAC; PAM sequence: AAAAAC
cctcagagcaagactccatc

SEQ ID NO: 5351 - DNA, 20 bp, Artificial Sequence
  Description of Artificial Sequence: Synthetic oligonucleotide
  Target: SCN9A; (-) strand; PAM type: NAAAAC; PAM sequence: CAAAAC
atcacttgaggccaggagtt

SEQ ID NO: 5352 - DNA, 20 bp, Artificial Sequence
  Description of Artificial Sequence: Synthetic oligonucleotide
  Target: SCN9A; (-) strand; PAM type: NAAAAC; PAM sequence: TAAAAC
taaatagaggaaagctgaat

SEQ ID NO: 5353 - DNA, 20 bp, Artificial Sequence
  Description of Artificial Sequence: Synthetic oligonucleotide
  Target: SCN9A; (-) strand; PAM type: NAAAAC; PAM sequence: GAAAAC
caaccaggatatcattaggg

SEQ ID NO: 5354 - DNA, 20 bp, Artificial Sequence
  Description of Artificial Sequence: Synthetic oligonucleotide
  Target: SCN9A; (-) strand; PAM type: NAAAAC; PAM sequence: CAAAAC
ctaaataagctataggaaaa

SEQ ID NO: 5355 - DNA, 20 bp, Artificial Sequence
  Description of Artificial Sequence: Synthetic oligonucleotide
  Target: SCN9A; (-) strand; PAM type: NAAAAC; PAM sequence: GAAAAC
aaggcctaaataagctatag

SEQ ID NO: 5356 - DNA, 20 bp, Artificial Sequence
  Description of Artificial Sequence: Synthetic oligonucleotide
  Target: SCN9A; (-) strand; PAM type: NAAAAC; PAM sequence: AAAAAC
atgtagattgtaacacagaa

SEQ ID NO: 5357 - DNA, 20 bp, Artificial Sequence
  Description of Artificial Sequence: Synthetic oligonucleotide
  Target: SCN9A; (-) strand; PAM type: NAAAAC; PAM sequence: TAAAAC
aaattagtttttaataatca

SEQ ID NO: 5358 - DNA, 20 bp, Artificial Sequence
  Description of Artificial Sequence: Synthetic oligonucleotide
  Target: SCN9A; (-) strand; PAM type: NAAAAC; PAM sequence: GAAAAC
ttgaaatgcctgtttgattt

SEQ ID NO: 5359 - DNA, 20 bp, Artificial Sequence
  Description of Artificial Sequence: Synthetic oligonucleotide
  Target: SCN9A; (-) strand; PAM type: NAAAAC; PAM sequence: CAAAAC
acacaatgtcacaaaggaca

SEQ ID NO: 5360 - DNA, 20 bp, Artificial Sequence
  Description of Artificial Sequence: Synthetic oligonucleotide
  Target: SCN9A; (-) strand; PAM type: NAAAAC; PAM sequence: GAAAAC
agattcagccaatgctgatt

SEQ ID NO: 5361 - DNA, 20 bp, Artificial Sequence
  Description of Artificial Sequence: Synthetic oligonucleotide
  Target: SCN9A; (-) strand; PAM type: NAAAAC; PAM sequence: CAAAAC
ttcaacttcttaacagttgt

SEQ ID NO: 5362 - DNA, 20 bp, Artificial Sequence
  Description of Artificial Sequence: Synthetic oligonucleotide
  Target: SCN9A; (-) strand; PAM type: NAAAAC; PAM sequence: AAAAAC
ttgtctattttatctttcga

SEQ ID NO: 5363 - DNA, 20 bp, Artificial Sequence
  Description of Artificial Sequence: Synthetic oligonucleotide
  Target: SCN9A; (-) strand; PAM type: NAAAAC; PAM sequence: GAAAAC
aagttgggttctacaaaatg

SEQ ID NO: 5364 - DNA, 20 bp, Artificial Sequence
  Description of Artificial Sequence: Synthetic oligonucleotide
  Target: SCN9A; (-) strand; PAM type: NAAAAC; PAM sequence: GAAAAC
atcgttttttgtacttgaga

SEQ ID NO: 5365 - DNA, 20 bp, Artificial Sequence
  Description of Artificial Sequence: Synthetic oligonucleotide
  Target: SCN9A; (-) strand; PAM type: NAAAAC; PAM sequence: CAAAAC
ctgagagtgctcaggcagtt

SEQ ID NO: 5366 - DNA, 20 bp, Artificial Sequence
  Description of Artificial Sequence: Synthetic oligonucleotide
  Target: SCN9A; (-) strand; PAM type: NAAAAC; PAM sequence: GAAAAC
agaaccacagggagcggctg

SEQ ID NO: 5367 - DNA, 20 bp, Artificial Sequence
  Description of Artificial Sequence: Synthetic oligonucleotide
  Target: SCN9A; (-) strand; PAM type: NAAAAC; PAM sequence: TAAAAC
tttaatcttcttaaatttgt

SEQ ID NO: 5368 - DNA, 20 bp, Artificial Sequence
  Description of Artificial Sequence: Synthetic oligonucleotide
  Target: SCN9A; (-) strand; PAM type: NAAAAC; PAM sequence: GAAAAC
gtttcatgtcatcatgaaca

SEQ ID NO: 5369 - DNA, 20 bp, Artificial Sequence
  Description of Artificial Sequence: Synthetic oligonucleotide
  Target: SCN9A; (-) strand; PAM type: NAAAAC; PAM sequence: AAAAAC
tttcgattttatcttttcaa

SEQ ID NO: 5370 - DNA, 20 bp, Artificial Sequence
  Description of Artificial Sequence: Synthetic oligonucleotide
  Target: SCN9A; (-) strand; PAM type: NAAAAC; PAM sequence: GAAAAC
ggattttttactatttctgt

SEQ ID NO: 5371 - DNA, 20 bp, Artificial Sequence
  Description of Artificial Sequence: Synthetic oligonucleotide
  Target: SCN9A; (-) strand; PAM type: NAAAAC; PAM sequence: AAAAAC
attgcagcaaaagtaatggt

SEQ ID NO: 5372 - DNA, 20 bp, Artificial Sequence
  Description of Artificial Sequence: Synthetic oligonucleotide
  Target: SCN9A; (-) strand; PAM type: NAAAAC; PAM sequence: CAAAAC
ttgtgcttatttatggggta

SEQ ID NO: 5373 - DNA, 20 bp, Artificial Sequence
  Description of Artificial Sequence: Synthetic oligonucleotide
  Target: SCN9A; (-) strand; PAM type: NAAAAC; PAM sequence: AAAAAC
actcatttattccaaagaaa

SEQ ID NO: 5374 - DNA, 20 bp, Artificial Sequence
  Description of Artificial Sequence: Synthetic oligonucleotide
  Target: SCN9A; (-) strand; PAM type: NAAAAC; PAM sequence: AAAAAC
ttctttccactcttccctga

SEQ ID NO: 5375 - DNA, 20 bp, Artificial Sequence
  Description of Artificial Sequence: Synthetic oligonucleotide
  Target: SCN9A; (-) strand; PAM type: NAAAAC; PAM sequence: AAAAAC
gttactgatttagaagcatc

SEQ ID NO: 5376 - DNA, 20 bp, Artificial Sequence
  Description of Artificial Sequence: Synthetic oligonucleotide
  Target: SCN9A; (-) strand; PAM type: NAAAAC; PAM sequence: TAAAAC
aagagcagtatgagcataaa

SEQ ID NO: 5377 - DNA, 20 bp, Artificial Sequence
  Description of Artificial Sequence: Synthetic oligonucleotide
  Target: SCN9A; (-) strand; PAM type: NAAAAC; PAM sequence: TAAAAC
gaataggaaatatgttccat

SEQ ID NO: 5378 - DNA, 20 bp, Artificial Sequence
  Description of Artificial Sequence: Synthetic oligonucleotide
  Target: SCN9A; (-) strand; PAM type: NAAAAC; PAM sequence: TAAAAC
ataatacaaacctgagggct

SEQ ID NO: 5379 - DNA, 20 bp, Artificial Sequence
  Description of Artificial Sequence: Synthetic oligonucleotide
  Target: SCN9A; (-) strand; PAM type: NAAAAC; PAM sequence: CAAAAC
aaatcaatacactatttatt

SEQ ID NO: 5380 - DNA, 20 bp, Artificial Sequence
  Description of Artificial Sequence: Synthetic oligonucleotide
  Target: SCN9A; (-) strand; PAM type: NAAAAC; PAM sequence: GAAAAC
atcttattcatttttgcaca

SEQ ID NO: 5381 - DNA, 20 bp, Artificial Sequence
  Description of Artificial Sequence: Synthetic oligonucleotide
  Target: SCN9A; (-) strand; PAM type: NAAAAC; PAM sequence: TAAAAC
cttttactgtttttacagtt

SEQ ID NO: 5382 - DNA, 20 bp, Artificial Sequence
  Description of Artificial Sequence: Synthetic oligonucleotide
  Target: SCN9A; (-) strand; PAM type: NAAAAC; PAM sequence: CAAAAC
ttgtggtaacattaaacaga

SEQ ID NO: 5383 - DNA, 20 bp, Artificial Sequence
  Description of Artificial Sequence: Synthetic oligonucleotide
  Target: SCN9A; (-) strand; PAM type: NAAAAC; PAM sequence: CAAAAC
aatggacatgttgaatacag

SEQ ID NO: 5384 - DNA, 20 bp, Artificial Sequence
  Description of Artificial Sequence: Synthetic oligonucleotide
  Target: SCN9A; (-) strand; PAM type: NAAAAC; PAM sequence: TAAAAC
ataaaatactgtgtggtttt

SEQ ID NO: 5385 - DNA, 20 bp, Artificial Sequence
  Description of Artificial Sequence: Synthetic oligonucleotide
  Target: SCN9A; (-) strand; PAM type: NAAAAC; PAM sequence: AAAAAC
ttagtcaaaatgtgcgatgg

SEQ ID NO: 5386 - DNA, 20 bp, Artificial Sequence
  Description of Artificial Sequence: Synthetic oligonucleotide
  Target: SCN9A; (-) strand; PAM type: NAAAAC; PAM sequence: TAAAAC
tagagtaataataataaatt

SEQ ID NO: 5387 - DNA, 20 bp, Artificial Sequence
  Description of Artificial Sequence: Synthetic oligonucleotide
  Target: SCN9A; (-) strand; PAM type: NAAAAC; PAM sequence: AAAAAC
aaataaagaaaggattaaag

SEQ ID NO: 5388 - DNA, 20 bp, Artificial Sequence
  Description of Artificial Sequence: Synthetic oligonucleotide
  Target: SCN9A; (-) strand; PAM type: NAAAAC; PAM sequence: GAAAAC
ccacaggaattgccctggat

SEQ ID NO: 5389 - DNA, 20 bp, Artificial Sequence
  Description of Artificial Sequence: Synthetic oligonucleotide
  Target: SCN9A; (-) strand; PAM type: NAAAAC; PAM sequence: AAAAAC
gtgtcaggtgttgtgatata

SEQ ID NO: 5390 - DNA, 20 bp, Artificial Sequence
  Description of Artificial Sequence: Synthetic oligonucleotide
  Target: SCN9A; (-) strand; PAM type: NAAAAC; PAM sequence: AAAAAC
tcattactcacattttttag

SEQ ID NO: 5391 - DNA, 20 bp, Artificial Sequence
  Description of Artificial Sequence: Synthetic oligonucleotide
  Target: SCN9A; (-) strand; PAM type: NAAAAC; PAM sequence: CAAAAC
tctatcacaactttccccta

SEQ ID NO: 5392 - DNA, 20 bp, Artificial Sequence
  Description of Artificial Sequence: Synthetic oligonucleotide
  Target: SCN9A; (-) strand; PAM type: NAAAAC; PAM sequence: GAAAAC
tataactaaattatatttga

SEQ ID NO: 5393 - DNA, 20 bp, Artificial Sequence
  Description of Artificial Sequence: Synthetic oligonucleotide
  Target: SCN9A; (-) strand; PAM type: NAAAAC; PAM sequence: AAAAAC
tttaatggggtttaaaatat

SEQ ID NO: 5394 - DNA, 20 bp, Artificial Sequence
  Description of Artificial Sequence: Synthetic oligonucleotide
  Target: SCN9A; (-) strand; PAM type: NAAAAC; PAM sequence: AAAAAC
attgtgatttttctcccatg

SEQ ID NO: 5395 - DNA, 20 bp, Artificial Sequence
  Description of Artificial Sequence: Synthetic oligonucleotide
  Target: SCN9A; (-) strand; PAM type: NAAAAC; PAM sequence: TAAAAC
ctacatgaggatgagcactt

SEQ ID NO: 5396 - DNA, 20 bp, Artificial Sequence
  Description of Artificial Sequence: Synthetic oligonucleotide
  Target: SCN9A; (-) strand; PAM type: NAAAAC; PAM sequence: CAAAAC
gacaaacattcaaaccacag

SEQ ID NO: 5397 - DNA, 20 bp, Artificial Sequence
  Description of Artificial Sequence: Synthetic oligonucleotide
  Target: SCN9A; (-) strand; PAM type: NAAAAC; PAM sequence: TAAAAC
tatgcatatattccgtgtca

SEQ ID NO: 5398 - DNA, 20 bp, Artificial Sequence
  Description of Artificial Sequence: Synthetic oligonucleotide
  Target: SCN9A; (-) strand; PAM type: NAAAAC; PAM sequence: GAAAAC
tgaaggatggtctcaaaact

SEQ ID NO: 5399 - DNA, 20 bp, Artificial Sequence
  Description of Artificial Sequence: Synthetic oligonucleotide
  Target: SCN9A; (-) strand; PAM type: NAAAAC; PAM sequence: CAAAAC
ttgttcttgaaggatggtct

SEQ ID NO: 5400 - DNA, 20 bp, Artificial Sequence
  Description of Artificial Sequence: Synthetic oligonucleotide
  Target: SCN9A; (-) strand; PAM type: NAAAAC; PAM sequence: AAAAAC
cacacaacatattaaatgtt

SEQ ID NO: 5401 - DNA, 20 bp, Artificial Sequence
  Description of Artificial Sequence: Synthetic oligonucleotide
  Target: SCN9A; (-) strand; PAM type: NAAAAC; PAM sequence: AAAAAC
atctcagacccaattatagg

SEQ ID NO: 5402 - DNA, 20 bp, Artificial Sequence
  Description of Artificial Sequence: Synthetic oligonucleotide
  Target: SCN9A; (-) strand; PAM type: NAAAAC; PAM sequence: TAAAAC
aatgtcattcttgttaagaa

SEQ ID NO: 5403 - DNA, 20 bp, Artificial Sequence
  Description of Artificial Sequence: Synthetic oligonucleotide
  Target: SCN9A; (-) strand; PAM type: NAAAAC; PAM sequence: AAAAAC
attcttactgtgtgttgtga

SEQ ID NO: 5404 - DNA, 20 bp, Artificial Sequence
  Description of Artificial Sequence: Synthetic oligonucleotide
  Target: SCN9A; (-) strand; PAM type: NAAAAC; PAM sequence: TAAAAC
aaatggatagcatatggtta

SEQ ID NO: 5405 - DNA, 20 bp, Artificial Sequence
  Description of Artificial Sequence: Synthetic oligonucleotide
  Target: SCN9A; (-) strand; PAM type: NAAAAC; PAM sequence: CAAAAC
tattgataccaacagtttcc

SEQ ID NO: 5406 - DNA, 20 bp, Artificial Sequence
  Description of Artificial Sequence: Synthetic oligonucleotide
  Target: SCN9A; (-) strand; PAM type: NAAAAC; PAM sequence: CAAAAC
ctcagaaagaagagtataca

SEQ ID NO: 5407 - DNA, 20 bp, Artificial Sequence
  Description of Artificial Sequence: Synthetic oligonucleotide
  Target: SCN9A; (-) strand; PAM type: NAAAAC; PAM sequence: TAAAAC
aattccttgttcaaaatgtc

SEQ ID NO: 5408 - DNA, 20 bp, Artificial Sequence
  Description of Artificial Sequence: Synthetic oligonucleotide
  Target: SCN9A; (-) strand; PAM type: NAAAAC; PAM sequence: GAAAAC
tcttgtgtgttataaaaagg

SEQ ID NO: 5409 - DNA, 20 bp, Artificial Sequence
  Description of Artificial Sequence: Synthetic oligonucleotide
  Target: SCN9A; (-) strand; PAM type: NAAAAC; PAM sequence: AAAAAC
catcagatattcaggaaatt

SEQ ID NO: 5410 - DNA, 20 bp, Artificial Sequence
  Description of Artificial Sequence: Synthetic oligonucleotide
  Target: SCN9A; (-) strand; PAM type: NAAAAC; PAM sequence: TAAAAC
tatacaatcgtaaggaggca

SEQ ID NO: 5411 - DNA, 20 bp, Artificial Sequence
  Description of Artificial Sequence: Synthetic oligonucleotide
  Target: SCN9A; (-) strand; PAM type: NAAAAC; PAM sequence: TAAAAC
gtttcctcagaagctataga

SEQ ID NO: 5412 - DNA, 20 bp, Artificial Sequence
  Description of Artificial Sequence: Synthetic oligonucleotide
  Target: SCN9A; (-) strand; PAM type: NAAAAC; PAM sequence: CAAAAC
ttactggcaatatcagtttg

SEQ ID NO: 5413 - DNA, 20 bp, Artificial Sequence
  Description of Artificial Sequence: Synthetic oligonucleotide
  Target: SCN9A; (-) strand; PAM type: NAAAAC; PAM sequence: GAAAAC
aaaatctggtggaacatcag

SEQ ID NO: 5414 - DNA, 20 bp, Artificial Sequence
  Description of Artificial Sequence: Synthetic oligonucleotide
  Target: SCN9A; (-) strand; PAM type: NAAAAC; PAM sequence: GAAAAC
aactaactaacaactattta

SEQ ID NO: 5415 - DNA, 20 bp, Artificial Sequence
  Description of Artificial Sequence: Synthetic oligonucleotide
  Target: SCN9A; (-) strand; PAM type: NAAAAC; PAM sequence: TAAAAC
gacaagaatacattgtaagc

SEQ ID NO: 5416 - DNA, 20 bp, Artificial Sequence
  Description of Artificial Sequence: Synthetic oligonucleotide
  Target: SCN9A; (-) strand; PAM type: NAAAAC; PAM sequence: CAAAAC
tctgtttttatctacctaac

SEQ ID NO: 5417 - DNA, 20 bp, Artificial Sequence
  Description of Artificial Sequence: Synthetic oligonucleotide
  Target: SCN9A; (-) strand; PAM type: NAAAAC; PAM sequence: AAAAAC
tactctttttgtgtgacctc

SEQ ID NO: 5418 - DNA, 20 bp, Artificial Sequence
  Description of Artificial Sequence: Synthetic oligonucleotide
  Target: SCN9A; (-) strand; PAM type: NAAAAC; PAM sequence: AAAAAC
aagcaattatttgcaaatca

SEQ ID NO: 5419 - DNA, 20 bp, Artificial Sequence
  Description of Artificial Sequence: Synthetic oligonucleotide
  Target: SCN9A; (-) strand; PAM type: NAAAAC; PAM sequence: TAAAAC
gctctgtttatcacttctta

SEQ ID NO: 5420 - DNA, 20 bp, Artificial Sequence
  Description of Artificial Sequence: Synthetic oligonucleotide
  Target: SCN9A; (-) strand; PAM type: NAAAAC; PAM sequence: GAAAAC
attatctgaagttgttactt

SEQ ID NO: 5421 - DNA, 20 bp, Artificial Sequence
  Description of Artificial Sequence: Synthetic oligonucleotide
  Target: SCN9A; (-) strand; PAM type: NAAAAC; PAM sequence: CAAAAC
aaacatgaaaagattcatta

SEQ ID NO: 5422 - DNA, 20 bp, Artificial Sequence
  Description of Artificial Sequence: Synthetic oligonucleotide
  Target: SCN9A; (-) strand; PAM type: NAAAAC; PAM sequence: AAAAAC
cataaaatatacatgataac

SEQ ID NO: 5423 - DNA, 20 bp, Artificial Sequence
  Description of Artificial Sequence: Synthetic oligonucleotide
  Target: SCN9A; (-) strand; PAM type: NAAAAC; PAM sequence: AAAAAC
cttagaaacttccagagaga

SEQ ID NO: 5424 - DNA, 20 bp, Artificial Sequence
  Description of Artificial Sequence: Synthetic oligonucleotide
  Target: SCN9A; (-) strand; PAM type: NAAAAC; PAM sequence: AAAAAC
cttgggatatacctttgcac

SEQ ID NO: 5425 - DNA, 20 bp, Artificial Sequence
  Description of Artificial Sequence: Synthetic oligonucleotide
  Target: SCN9A; (-) strand; PAM type: NAAAAC; PAM sequence: TAAAAC
tttttactgaagataaatgt

SEQ ID NO: 5426 - DNA, 20 bp, Artificial Sequence
  Description of Artificial Sequence: Synthetic oligonucleotide
  Target: SCN9A; (-) strand; PAM type: NAAAAC; PAM sequence: AAAAAC
ggattgaacattgggtgctt

SEQ ID NO: 5427 - DNA, 20 bp, Artificial Sequence
  Description of Artificial Sequence: Synthetic oligonucleotide
  Target: SCN9A; (-) strand; PAM type: NAAAAC; PAM sequence: TAAAAC
gtctccaacaaacaaacaaa

SEQ ID NO: 5428 - DNA, 20 bp, Artificial Sequence
  Description of Artificial Sequence: Synthetic oligonucleotide
  Target: SCN9A; (-) strand; PAM type: NAAAAC; PAM sequence: AAAAAC
ggatatgcataacatttggg

SEQ ID NO: 5429 - DNA, 20 bp, Artificial Sequence
  Description of Artificial Sequence: Synthetic oligonucleotide
  Target: SCN9A; (-) strand; PAM type: NAAAAC; PAM sequence: CAAAAC
gagggagatggagctgtgaa

SEQ ID NO: 5430 - DNA, 20 bp, Artificial Sequence
  Description of Artificial Sequence: Synthetic oligonucleotide
  Target: SCN9A; (-) strand; PAM type: NAAAAC; PAM sequence: AAAAAC
caaaccaaaaaatgacttca

SEQ ID NO: 5431 - DNA, 20 bp, Artificial Sequence
  Description of Artificial Sequence: Synthetic oligonucleotide
  Target: SCN9A; (-) strand; PAM type: NAAAAC; PAM sequence: CAAAAC
ttgaaaagcaaaaacaaaaa

SEQ ID NO: 5432 - DNA, 20 bp, Artificial Sequence
  Description of Artificial Sequence: Synthetic oligonucleotide
  Target: SCN9A; (-) strand; PAM type: NAAAAC; PAM sequence: AAAAAC
tttttttgaaaagcaaaaac

SEQ ID NO: 5433 - DNA, 20 bp, Artificial Sequence
  Description of Artificial Sequence: Synthetic oligonucleotide
  Target: SCN9A; (-) strand; PAM type: NAAAAC; PAM sequence: AAAAAC
tttttttttttttgaaaagc

SEQ ID NO: 5434 - DNA, 20 bp, Artificial Sequence
  Description of Artificial Sequence: Synthetic oligonucleotide
  Target: SCN9A; (-) strand; PAM type: NAAAAC; PAM sequence: TAAAAC
tcatcaccatctgttgtttg

SEQ ID NO: 5435 - DNA, 20 bp, Artificial Sequence
  Description of Artificial Sequence: Synthetic oligonucleotide
  Target: SCN9A; (-) strand; PAM type: NAAAAC; PAM sequence: GAAAAC
aatctactcactaactctca

SEQ ID NO: 5436 - DNA, 20 bp, Artificial Sequence
  Description of Artificial Sequence: Synthetic oligonucleotide
  Target: SCN9A; (-) strand; PAM type: NAAAAC; PAM sequence: CAAAAC
ggtcattggcattttgattt

SEQ ID NO: 5437 - DNA, 20 bp, Artificial Sequence
  Description of Artificial Sequence: Synthetic oligonucleotide
  Target: SCN9A; (-) strand; PAM type: NAAAAC; PAM sequence: AAAAAC
ctcataaagctctgggtgag

SEQ ID NO: 5438 - DNA, 20 bp, Artificial Sequence
  Description of Artificial Sequence: Synthetic oligonucleotide
  Target: SCN9A; (-) strand; PAM type: NAAAAC; PAM sequence: TAAAAC
tatgctgctttactccttta

SEQ ID NO: 5439 - DNA, 20 bp, Artificial Sequence
  Description of Artificial Sequence: Synthetic oligonucleotide
  Target: SCN9A; (-) strand; PAM type: NAAAAC; PAM sequence: TAAAAC
attttaaaacttatatattt

SEQ ID NO: 5440 - DNA, 20 bp, Artificial Sequence
  Description of Artificial Sequence: Synthetic oligonucleotide
  Target: SCN9A; (-) strand; PAM type: NAAAAC; PAM sequence: TAAAAC
tcctggattaatctgtattt

SEQ ID NO: 5441 - DNA, 20 bp, Artificial Sequence
  Description of Artificial Sequence: Synthetic oligonucleotide
  Target: SCN9A; (-) strand; PAM type: NAAAAC; PAM sequence: TAAAAC
aggtcaggaattgaagccat

SEQ ID NO: 5442 - DNA, 20 bp, Artificial Sequence
  Description of Artificial Sequence: Synthetic oligonucleotide
  Target: SCN9A; (-) strand; PAM type: NAAAAC; PAM sequence: CAAAAC
ttcctctcactgctttacct

SEQ ID NO: 5443 - DNA, 20 bp, Artificial Sequence
  Description of Artificial Sequence: Synthetic oligonucleotide
  Target: SCN9A; (-) strand; PAM type: NAAAAC; PAM sequence: AAAAAC
aagttgttaccagctcagag

SEQ ID NO: 5444 - DNA, 20 bp, Artificial Sequence
  Description of Artificial Sequence: Synthetic oligonucleotide
  Target: SCN9A; (-) strand; PAM type: NAAAAC; PAM sequence: GAAAAC
aatgctctcttaaacagtga

SEQ ID NO: 5445 - DNA, 20 bp, Artificial Sequence
  Description of Artificial Sequence: Synthetic oligonucleotide
  Target: SCN9A; (-) strand; PAM type: NAAAAC; PAM sequence: TAAAAC
aattgaccattaaaaaaaca

SEQ ID NO: 5446 - DNA, 20 bp, Artificial Sequence
  Description of Artificial Sequence: Synthetic oligonucleotide
  Target: SCN9A; (-) strand; PAM type: NAAAAC; PAM sequence: AAAAAC
tgaattcaattgaccattaa

(The sequence listing continues in the following parts.)

The invention claimed is:

1. A method for editing a Sodium Voltage-Gated Channel Alpha Subunit 9 (SCN9A) gene in a cell by genome editing comprising: introducing into the cell (a) one or more *S. pyogenes* Cas9 (spCas9) endonuclease or one or more polynucleotide encoding the one or more spCas9 endonuclease and (b) one or more gRNA or sgRNA or one or more nucleic acid encoding the one or more gRNA or sgRNA, wherein the one or more gRNA or sgRNA comprises a spacer sequence that targets a sequence within or near the SCN9A gene to effect one or more single-strand breaks (SSBs) or double-strand breaks (DSBs) within or near the SCN9A gene or SCN9A regulatory elements that results in one or more permanent insertions, deletions or mutations of at least one nucleotide within or near the SCN9A gene, thereby reducing or eliminating the expression or function of SCN9A gene products, wherein the spacer sequence of the one or more gRNA or sgRNA consists of an RNA sequence corresponding to any one of SEQ ID NO: 46832, 49122, 49431, 47474, 47446, 28779, 29821, 28146, 49436, 47224, 47462, 47240, 27323, 27522, 27893, 47261, 28137, 49367, 47232, 47445, 49313, 47267, 30622, 47231, 26766, 28139, 46079, 48091, 46833, 26765, 27876, 47241, 47248, 30051, 30111, 28760, 28085, 27254, 30163, 49303, 28083, 49344, 47245, 48090, 28132, 27328, 46078, 28773, 46496, 27885, 29928, 27933, 46039, 47439, 28774, 47455, 30020, 47236, 28089, 26813, 47464, 28091, 29908, 27892, 28776, 28783, 27252, 29930, or 47625.

2. An in vivo method for treating a patient with an SCN9A related disorder comprising: editing the Sodium Voltage-Gated Channel Alpha Subunit 9 (SCN9A) gene in a cell of the patient according to the method of claim 1, optionally wherein the cell is a neuron of the peripheral nervous system.

3. The method of claim 1, wherein the one or more spCas9 endonuclease comprises one or more nuclear localization signal (NLS) or the one or more polynucleotide encoding the one or more spCas9 endonuclease further encodes one or more NLS.

4. The method of claim 3, wherein the one or more NLS is at or within 50 amino acids of the amino-terminus of the spCas9 endonuclease and/or the one or more NLS is at or within 50 amino acids of the carboxy-terminus of the spCas9 endonuclease.

5. The method of claim 1, wherein the one or more spCas9 endonuclease is one or more protein or polypeptide.

6. The method of claim 1, wherein the one or more polynucleotide encoding the one or more spCas9 endonuclease is codon optimized.

7. The method of claim 1, wherein the one or more polynucleotide encoding the one or more spCas9 endonuclease is one or more DNA.

8. The method of claim 1, wherein the one or more polynucleotide encoding the one or more spCas9 endonuclease is one or more RNA.

9. The method of claim 8, wherein the one or more RNA is chemically modified.

10. The method of claim 1, wherein said one or more gRNA or sgRNA is pre-complexed with the one or more spCas9 endonuclease.

11. The method of claim 1, wherein the one or more spCas9 endonuclease or the one or more polynucleotide encoding the one or more spCas9 endonuclease and/or the one or more gRNA or sgRNA or the one or more nucleic acid encoding the one or more gRNA or sgRNA is formulated in a liposome or lipid nanoparticle.

12. The method of claim 1, wherein the one or more polynucleotide encoding the one or more Cas9 endonuclease and/or the one or more nucleic acid encoding the one or more gRNA or sgRNA is provided by an AAV vector particle.

13. The method of claim 12, wherein the AAV vector particle is selected from the group consisting of AAV1, AAV2, AAV3, AAV4, AAV5, AAV6, AAV7, AAV8, and AAV9 particle.

14. The method of claim 1, wherein the cell is a stem cell.

15. The method of claim 14, wherein the stem cell is a pluripotent stem cell, an induced pluripotent stem cell (iPSC), a mesenchymal stem cell, an adult stem cell, or a somatic stem cell.

16. The method of claim 1, wherein the cell is a somatic cell.

17. The method of claim 16, wherein the somatic cell is a neuron of the peripheral nervous system.

* * * * *